United States Patent 10,233,495 (METHODS AND COMPOSITIONS FOR SCREENING AND TREATING DEVELOPMENTAL DISORDERS) - sequence listing, part 39

SEQ ID NO: 457 - DNA, 4997716 bp, Homo sapiens (residues 1-1,665,906 of 4,997,716)
atgagccattatgaaactctgtaggaattcgtgtgatagactcgaaggtgaaatcaattagggagcaaacagacaaattcctttgtccatttgggtggtcccacatatcaggccatagctatgacggaaaatgtttcctgacttcctcacaccgttcacattcctcattctgaaacattgtaccaatgtgttccacgccgtgtttctcaacttcttcttgagcttccaactttgggatcataggaccactttcctgtttggggttttacctttacacttgactttggtacttacttgctctctggctttgacctttgcattcctccttgagtccaaatcagattcctaccagttactactttcagctgtcttgattagcaccccaagtcattaggattggatttgaaccctataatttgggtgacaaatgctccagtcaggtgctgtgacccctcaggatccaggcaatgacaaaggtgcttgcgttacttaaatgttaattcagacaaggcagttcagtggggagtcatccctttgccccatgtgtgtcttctagtgtttatgcataaacactctgtactttccagtaatttatctctcttcttttaccatttcattaaactgccaggcaatatttttgtatgctttcgaaaagctctgtgaaggctcctctcagtgatgggtgaaatgatttctaaaaataacctgcaaatcaatttgttcagcttgtagcttgtataaatcttgaagtaaggtgctattaaatgtgcaaaataaaatattttagtttagaatatgttactaataccctgcgaaaagagccctggatttagaaaacaggacttgataatcctggctttatggattactgattgtgtggctttaggcacatcatataacttctccagagcctcagtttctttgattgcaaaatgagagaataacatctccctcattgtattgtggcaaagtacaatgagaaaacatgaaaatggtgccgatagaaagctgggtatcatttggtagacttactacacatttgttaatctttgtttgaacacaaaacctaaaagtgattccaagtagtcactggggtatacggaaaagctgtaggaaagtttacttttttaaaagagttgcatagaagaaaaacaaataaacaaacaaagaaaaagaaaaaagctgcatttcagttaagttgattagaaagaaaatttccttagaatgagttttgtttttatcttcattttaaggacgcaaagcagaatgtgttgctggtgaatagctttcatttaggaaatgcactaggagtgcatttgcagaaatttttgaatattattttactgatataagtttcttatgtggccccaacatacatgtctttccctaagccagaggaatgcctcttattttgcatgtccctgcatgtcatgctcagagataccagaatttaaattcttttagtctgttacttgaataaatacagtctcatagtgttaagctcaaattgttattgagtacacaatatatattacctcagtccaaattttacccaaacatgaaactttagattctatgaaacagattaatatacatttatcaaaactctaaatttataatgaaagtccctttgctgagagaaaaaccagcatattaagcattgctttaatccccagctattttcctagttgttttacttttattatttcatcacattttcaatatgacaaatatcatcattgccattttacagataaggtaactgaggctgagtgaagtgaattaagtggcctaagttgtaaatggtacagctttcttggctccttagccagtgcgcttctccacggagaagtgtagtggttacaccaggactcccgaagaaggaaaaaaagagcaaataaatcagccatttattctacaattctgctgttttgagcttttctcaaaaggccatattcttagttaactcaatttagtctcaataagattgatacagctcctatgatttgatattctgactagtaaggggagctgctgaaagcattttggatattaaggaattattgggcacttctttcaacatgtctgactaatgctcagaatattcattttcctacagagtacgggagtgtgatagatgacgtcatgtttattacagtttgcagggaataaatgccacaggcccattgacatgctggggaaagggcttgtcagtgtggcacatctaatataatcttcatcataaacaatggcctccacttctggccatgtccaatgtgtaaggccctcacctggatctgatattttctcctgcccagcacctacctctcctctttttaaaatagcatctcaagtgtcttagaggctctctctgtttgggttaattttaagtgatacataaaattgactgggccaagggatgcccagatagctggttaaacattacttctgcgtgtgtctgtaagggtgtttctgcaagagattagcaatgagttggcaggctgagtaaagcagatagccctctccaatgtgggtatgcatcatccaaactactgagtgcctgaacagaataaaaaggcagaggacagagctggaaccttgatcttttactgccctcagtgctccaattcttaggcttttcgaatttccagacagacaccagcttttctggctctacagcttgtagatgccagatcatgtgatttctcagactccataattgtgtgagcaataacctaatatcttatagtaaatctctctctctctgtagctttatacatgtagctttatacaaacacacacacacgcgcatgcatacacacacacacttctcctattggttctatttctctggagagctctgactaatacaccctttctcctactgtgggtccgtttgatttagtaggggatggatcccaccctcggcttcacgaggatgcatgactcaggctcattcagtaagtaggccccacctctgggctgtagggcttgcagggactggtaagaagctggatacttgactcaaactggtgaaatgctgagactgttggaggaagcactggaaacaggggttgtctttcctctggggatggtaagctgatgagatgtaagctaagatctactggtggctttcttgtttactgtacaaggaacctgcctgagaatagaactaactgacagaaaagcaaagttgaatgcagaagacacacagaaagaggtaaaggccaaatggtactgcctgaggcctccttagatctagccattctgtagctactggacaattcagtttcataaactactgtggcttttctcttttttcctttttgcataaatgaacacaagtgattctgtaggcttttatatattcagtctggttccaaatccttttcccctataattcactagattacacctgatgctgaataatgaatgtgcacagtacacagtggatttcgatagaatggaaaagtggatcagctggagtagtacagccaccactaagggaggcgtattgtgtgtgtgcgtgtgagagagagagagagagacagagagagagacagagagagaatgtgtattggcaaaagaaaaagacagtgtcacattcaaacaacaggttcatatgataattagttaaataatgaaaacctttgaagctgcccaagataatttcaggccccagacgtccagcacaaggtgttccactcaattttagtccactggcaacactgaaacatcctcctttgaaggtgtgaacaagaaaggatgagaagagccctcacaaatataggatgcacctgcatgtaagggaaactttggaagggtctttaactacctcaaccaaaaaaggaagttcaatagacaaaggcctccaaggattgaacaatgcacagtgtagccacatgccagccccctgagactcacactagtggggctcccacaggacagggccaggctgtgaaatctcccatgggcagaaaagagatgtgaagagaagaggctatcagaaaatgaagaaaaggaccatagggaatcaatctttggaaaagcagggctcaaggtgactgaagaccacagtgatggttgtgttcatttgccctcagtcatccatgcactaccatcatggttttgccatagctgggttctatctctgcgattattaacctagtactttaagagtagtttaaaggactcacttttctttcacttcctcgttgcttctaagcaataacttttgagaaatgggtttatttctctggttaaaagtacagaaccagttatatactttcctagtatatgttaaaataagcatataatcattaaaaatgtttgtggtaccacctaaaatcttttcaaatgtcacagtactggattccactcattgggcaacactagtatataggacaaggactggagttcaagtcaagaacaaggatgaggataaaagttgcttcccttgagatgctgatattgtccagggatatcagtttcatcactgctttcctgaaagctctacccctcccctctgctcagggcactccaatgcctttatactacaagggaagattgtttgcaagcaaacactggaattataaaaatgagtaaaatggtcaaatgtggagcttttaacaagaggtaagtatattattgttacctcctgtcttcagaaagggctaaagaatgaccaaggagttcactgcattaacctatctgtaaaagcagtagataccaaatgtcatacttatgtcatagatgaatggcaattatgtatgcataactaaaagtataatttaaaaaattctctcaaggcttatcaggaaaccacattaagcagaacaagtcatgtatctttaaaagccatgaactatgttgtcaagtcacaaaacagttgccacttgaactctgggaacagactttcaaagacagatttctacaggtttttttccactagaattttacagacactaataatgacctcactagattttcttttgattcatgctagaaaaaatagactgtaatttagatattgtttgaagatggactgtaataccatacgacaaaattgaagccaccttattagttttttttggtctttaaatttcatgtttagcttcactgtggataaaatatgccagcagtaaaacatgaaacacggccttctctttgaattgcaaagaaaagatgctttatttattttgtgacttcaggtggagtaatggtttctcatccttccaataatcactctttattcactcagcctgctttatttttcttcctagcacttgtcactatgcatcacattcttatttgctgtgtttattgtctccttcctccaccaaatgtaagctctttgagggcagggactttatattagtcatgtagtctcccagcacctagcaaaatgctcagtacataggaagtgctcgataaaaatttgttagatgaatgaatgttgattaatgaccaaacgtttacaattagcaaattgtctcatttttcaagctttactcatcagcttcagatccaaaaaatacatacttgttagccatttgaccttaggcaagtcacttaaccacataacttctaacaggttgtgtttctgtccataaaatggggacattattgactgatagggcatttgtgagcataaaatgaggtaacatccatgaaagtgttggtttgtctatcttttatttatttacttatttatttttattattattattctttaagttccagggtacatgtgcacaatgtgcaggtttgttacatatgtatacatgtgccatgttggtgtgcatatacccaaaggattataaatcatgctgctataaagacacacgcacatgtatgtttattgtggcactattcacaatagcaaagacttggaaccaacccaaatatccatcaatggtttgtctatctgtgtaaccaggtctctgatcattcatttgtctatatatgaatgcagcctgttggcaaaggatttggtccatggtaggtgcaccatgactgtttactagtttattaatttttaattttaattttgctacaggaagtaatgatttccttttcagttgttgatggccctgtctaaaaccaaggacaagaaatcactagatgaaagcattgcctttatatacctaaactcttactctttatatatcttcaatataaagagatttaaaaacggtgttttttccaatcaagtacatttagaggacaaaaataagaaaaggacatcgacaagactgataagcactaaagtcatcttccctgtccctcctaaaaggtcagtttcattttgtttttaagatgcttctcatgtacagaagacagtgttgggaaaagatgagtttgatttttataaaggtgatttccgaggcactctttatttatttatttattttttaaaaataacttcttccctttcttctttcctttctttttctttctttttacctgtctttgttcattaactagaattaaattaagtttttggttatttcccacaagcaagataaatatctaaaaaacagataggttgggggaggaaaaatggtcaatagaaactttcttagaagatgaaaatgtatgttaaatcctcttcaaattataattttcaaattctcactgctaagacaaaattaattagttcaactaaaacagagttgccaattaaaacatggttaactaggattctctaaaaaaaaaaatcccaaatcttacactgttcattctaaataaacatgcttttaaagattaggaaaataattacctatttgcacaggaaaataataaatgatgaaatctcaacagatagggtaaagatatcataatattatcttagcaattggctcaatcacttcccactcagtttaaacgctttaataaaaggtattttatacaaggaaagtcctaaatcaaggttattacagattacatttatgtaagtatttgttctctcactaatggaagatttcctctctaatattttttctaaataatttgttaaccggagaagaggaaaacaaaatatttttttctaaaattctatcgaggacttataatttattttacttttattctctgataaagaaaaggctacagggaaactagcaggcgaaagactttctaaatgtaaatgctgcccaaagaaaaaaagaactgtgattagattattaggtataatatgcatcaagggttaaaattcatatacggagaaatgcatgtcaattgcacatattttaaaattcactttaggaatttatcataaagagttcagatatgcacaaagataaacttcatggcaatattagttacagaggtaaaagaatacaaatccttgtttcccacagcattcaggcaagtgagactaccctatggagacaggaggctgagcatctgcagaatttaaactaggaggcttggactcagagataccaaacacagccaagggcaagcatggcatacagagtgaaaatggaggaactgtgcaaattgctgtactaggcccctcatcaagttgatttccctgtttttttctttttcctccggcaaagatgggagctggggagaagcaaatgaccccagagagaaggccgttggggatttaaatttggggcaaataaaaaggccggccagccatatatttatcctagagcagcagttctaactggaatggggcgggggtgggcttccccaggggttagagacatttttgatttccataactggaggggcatggtgctactggcatctagtgggtagaggctagggaagctgctaaacatcctataatgcaaagaacaacaaaacagccctcacaacaatgaattatccagccccaaatgtcagtagtgccactgtaaagaaaccctgtaatagagtgaagcccacagttcacacctgtcccatgcctccattactcacacaggacttccaaaggctcttttgggctttggaatatgattggcttgccttttaccagacacttgaggaaagccctcacaatgaaagtcaagacaaaaacccacaaacatcaaccaaacaactgaataagaaaaaaagtattggagaaaacagaaatcattaaaaatcttaagaagaaaaactgtaattgatacaacccaatctgaaatataatttggcaatatctagcaaacttgaagctaaacccacgtgaaacccagcaattctgcttgtagggatttgtctcagagaaattcttgtacatgtcactaggagagatgcacagattattcatagcagcattgcttgttagtagcaaaaaaaaaaaaaaaaaaaaaaaacctagaaaaaatctaatcattcaccaaatgagaatggatagattaattatagactattcatataatttgaatgccaaaatcacttaaaatgaatgacttagagctaagtatctcaatacagatacacttcataaatataatattgacttaaggaaagcaaattacaggggaccacattcattaagatactatacaaagttaacaagctttgaataaatacatgcaacaactttactatatctactttaaggcaggggtccccagtccctgggctgtggaccagtaccagtctgtggcctgttaagaaccaggctgcacagcaggaggtgggcaaagggtgagtgagcattactgcctgagctttgtctcctgtcagatcagtggtggcattagattctcacaggagcaggaaccctattgtgaactgtgcatgtgagggatctaggttgtgtattccttatgagaatctaatgcctgatgatctgaggtggaacagtttcatcgcaaaaccatcctcaccacacccctaagccccaacctcggtctgtggaaaaactgtcttccacgaaactggtccctggtgccaaaaaggttgggaccattgctttaaggattcatactcgtctaccaaatctataaggcaatacattttagctatcctccagactcaacatgggaaaaacagggaaatcaacttgatgaggggcctagtacagccatttgcacagctcctccattttcactctgtacgccatgcttgtccttggctgtgtttggtatccctgagtctgggaggttggcaggaaggaaagtaactgggatgtgtattcagagaactttgagtatgtgatgttttatttcttaagctgcattttgggtctactggtgtttgctatattattctatatcttttgtatgttttaagttacattaaataaaacctatttttaatatcatccgaaagataaaagaaaatattgcatccaggaaaaagcaatgtctcattcatgaagcaggaatttaactccacaaacatagcacttctaagaaaatctaatgtgtagtaaagctattacatgttttaaaatataaaattaaaatgtatgggctttctttaaaacatttgtaatttaatttcaaatatataatttaaatttaaccgtaatggcatcattttagaattgagtttttcttttctaataaccaggtatataaggtaactttgtcatgtacctggtttgaaaatgttataatagatcccaatacatcatatgccatgtcgagctattttcttttaagtgttcttaatactaagcattggggtaaatttttaattgctaaaaagtgtaactgattatatttgaaatatttagcagttatgatccacaataacaattctaggaaattaaaaaaataacatgttagtcaatgttttaattaatatattaagaacctacacaagtgattgcatcaatggctattgaaattgaaataatgacttctgaaattattttaaaaatatctttttctaagaacatatggacacatggtggggaacaacacacactggggcctgccgggggtgcagcgggagggagagcatcaggaagaatagctagtggatgctggacttaatattcaggtgatgggttgatctgtgcagcaaatcaccatggcacatgcttacctacgaaacaaacctgcacattcggcatatgtaccccagaatttaaaataaaagttgaagagaaaaaaatcttttccttggcactattttgttctaaccagagaactaatttaggaattgagaaaagcataaaaagtatctgttctttttaattgcataaataagtgatacaaaaaaagttctgagtgagttctataagtaaatattttaatttccttacactggcttagctaaaattatcattttgtcattttagaaatattgtattattataccaagtagtgaaacatttaaaaatatacatttagcaggttaaaataatcatgttcatcttttaaagaaaaagatcctcaaagaagacacaattcatactttccatttttcattgacatcattaagtactcatttaaattagtttcggaaactgaaataactttacatttttttgatatggtggcaaagttcacctgaaaaaacaatttctaatttaatcattccttcatacatggtatgttccctctaaaagtgacaactctatacttctaatatatgtaaatatatattaagaccatggccaataacaaaacaaaacaaaaatgaacaaaaatgttttaatatggaaacatttttatgaaattaaatttccctggctagttattgaaatttatcttatttaaatgatttaagtttattctagcaagtgcttctaaggtggagatgctaatacaggttgagcatccctaatctgaaaacccaaaatctgaaatgctccaaaatccaaaacgttttgagcacggacatgatgccatagatgaaaaattccacacctgacctcatgtgacagttctcagtcaaattgcagccaaaactttgttttatacaaaaaattaacaaaaatattgtataaaatcaccttcagactatgtgtatatgaaacataaataaacttgatgttgagacttggggtctaatccccaagacctatcattatatatgtatatgtagatatttcaaagtccaaacaaaaaaatctgcaatccaaaacacttctggttccaagcattttggataagggaccgtcaatctgtatagctgtgtctacaaaaataaaatggtaaccaagaagaactctaaaattagatttgtaaaatctccttcagctctaatatttcatttactcatcccttcatctttaatgacttcagtcattcatttgttcgctccttttagagacttcctatgtgccatgcagtgtgcactctggggatataaagagaaacaaaagaaatttgctttagctatagtacatcagtatgaaaggtgggaagggatcacaaatccaaatatcaaatacacacagagttcactctctgtattgcagaaggaaaggaatcctgcctaggtgacatggacccacccatagagaccttttgtatgggaattgtaccactgctctagcactttgctcacaaagtatggcatatcacacttccattcatttatagtggaagacatggaggcacagagaggtgagagaacttgtcgaaagtcacagagcaagttagaaggccaaaatcagaatatatggtctattgtaatattttcaacaaatgtattgaaaacttggcaagtgtctggcttagaaccaggaatggggactacaaagatgaataagatggaattcctgcctagaggtgcttatgttctggtgctggcagttcccagactcgggggttctggcaattactgtaacagctgattatcttggtacctactgctgggtctctgagtactgtgttagcatataaacaaacgtggaactgcatggggacaagaacggctggcaaagtaaacatgggaaaacatattcagtgtggctgtaatctgtaaaatgcaaattcaaagaagaatttgtttctacctatccatcttgcaaaagtcttaaaaacactcaaaatggagaaattgcccctctcatccactgctgttggaaataaaaattttgtgtttagataccaaagttgcagcattatgtacaggcttataaccaggaacaattatgttcaacagtaagtgaataatgtttcactaaattacggttacattcatgcaatattatgatacatgaggcagtttcttaagattacttaatgacctgggaaaatattcatcatccaatgttaattagaaaaccagcatattaaactatatatgacatgcattttctaaaaatacttttctaaaaatacagtatggatgcatatctgtatcataaacactggaaagaaatgtatcaaattaatacttgtgattatttctggggggtggtattacagatgatttttatttttctcctttgtatgttttccaaattttctgcaaggagattccattatttaataatttagaaaaaataaaagtaagtcttaaatttttttttctgactagatgattctctgaaataaactaactgctcctgactggtttcaggacaccaatgactcagccccttctggttaggacacacgggtgcactagagaggtcctgagacctgagctccatgacccagatttgttttgctgcttactggctgtgtctttctgggcaaaagagtcccgagcctctgtaattgtatttgtaaaatgtggcaattgacgtctgcctcacagatgaagtttaaagacagtataagaaaaatgctttgaaaagtactatataaatgcaagctatgtctcacctgagacatagataagacagagaacacactcaaatcccaaatgaccaacttcttggttttatgacatcacttaaatgacagaacctctttgagccttagcctcacaatttgtcaagtagagatattactggcttcttcagaaggtggatgtgaactaaacaccttttgcaggactcagtaaatgttagctttcttcctttcttaggctctgtctttccccactccactcttactctgaaacaaggatttaaaaaaatgctctggcatcagcactttctattctaattttaaagcatattatttactttgtttttttgatatgttaaaaatgtatggattctttttcctttctccacccttttacgatgtggacaaacagcaaacacaaagtaagcagaacttgggaaaatcaatgtgaggactgtggacaaattttatggggtcatttgagcctgaagttttccacagaaagctctgaaactctaagcactttcctttagggcaggcagagtaggaagggtaagaacgtccttgctttggtaggctgaaattatttcagcaattagatctccctagattctggatttatctaaatatacctgtgacattctgtaaatgtgcagaactcagaacttctcaggcctggtttctgtagtgtcaactgacaaccacatgctttgaaattttgtttcctttaattaaccttctccattttcaaatcaattttctcacttcctcatggtgttactgctattctaagaaatgcagacctaacggatcaacatttcaagactccaaaggttcgtatgccaagcctggaactttgtacacaaatagatatccaagaatactcgctgttcattctgtatacccaaacttaaaaattcaagagctaagattaaagtatcagaggattgagtcctaatttactatttgaaatctggtctaccttgtataagaatcttttcttgtgggaatgttgaagatttttgagaaagagaacaacccactgaaggccctccctgtttagggaagattaacctgttaggtgctagtagattgatcgaaggggatgatctgcatgtaccatgactgtgaagacagattaaaaaggaagaggcagataaaagacatattgtagcggaatccgctagtgcccagtccatttttccagagtcttagcacttcactgtgttctggctgatttctaactgccagcgtctacccacctttagttgagtgctaaggaattcatacccccatgccaagcagcacttagtccacaaccggtaggagttgatacataaacagtccagctcccccgcactttgggtggaagaactctgagctgtgttgtattagtttcctactgttgctgtaaaaaaattaccaaaaactaaagaggcctaaggaaacatgaatttattactgaacagttctggaggccgtaagtttgaaatagaccttactgggctaaaataaagacgcaggtttgaagacagtacactattgctttgcaggatgctgaccaatcttctggcacaagtagacccaaactgtggtcagcttattctttgaaggagccttcttgaattcctcttctctttataatcaaaaccgagacaggagaatgtgctggtgaaaattcctccacactatgctgaaatcaatcatatcaggcctcatcttaatcccacttaatttaactgaatcctgccatttgatctaatccatctaatttaatcccactttggcacaatccaaatctagaatacttgagtcaaatcatctaatactccaagactagcagtagcctaccgtggatggaaaacgataacaaagttacaaggtacatagagtcagaatctcttgtttttcattctggctataaaaaaaccacatgatcttagactaatcacttaatctctctctgaccgattttatttcttcatgtaaagacagaattaataaaactccttttttgagagatttcagagtgaaatggaaaactgtgaacttgctttgagttctaatacaatagcactaatcatgatgatttgaaggacagtaaaccttttgtttttcccatgaatgcaggttttagtcaaatgccagcattctctgtacacttggtgctcctaaaacgtttattgtttttcataatgaagaataatgtcttatgcaaagcaatctattcacaaaccttctcccagttggaactgatatatgttgagccatctcagttattctgataaagcccctcactacatttgtatctaacttcatcacaaacaaatgatctcgatacactttggggttctgcaagatttaacaacccatggtgacttgtcgcataacagaaaacttgactttttgctctattttaaattacatttgagtattttttattgagaatctattaaaactagggctcccagaactggtctttcagtagtttacataataatagctacaataacaactgatgtctgcgtcttgcattatagttggcagtggcttcctatagttagatgttgcccaaacttcagtcatttttataacatcagcatgatattttgccatattttcttaatttacgtggtactaactaccaagtgttttatcttgagttaccttttaaaatttaaatgtttatttaaaaagtgaacttcatatcactaccatacctagaaaacaaatattgcttgccataaatagaaaataaataaattcattgatttaggcatgccataaagtatacatatagcaaaacatcatgttgtgcaccataaatatatacatttatatttgcaaataaaaaataataatttttaaaaagaaagtaaataaatgcaatgcaatgaaaacaaaacaatattgttcagttcctttctatactgttgttgggtaaaagttcctgagcttgagatacattcttttgtgtttgtgtgtgtaagtgtgtgtactagagagaaagagagagagagatactcgcatatcttatatcaaatttagatacaaactctacattgagacttttggtgaattatttacaatttttggaaatgacatgatggattagaatcttagtaagcagtgcagatactgtatccattttacagatgataaagctagggctcagagagattacatgacttatttcttcaatactcagtaaatggcagagctgggcttcaaacacgagccctttcattccaaatcctgtgctttctctattgcactcaaaccttcttggagtgagaggggttgcagagggcttagatgaagcacactaaagatccattccctctgtcattcataatccagtcaaggagatgagagggaccaaagtcatatatttaagttgtatcaagagaaagtaggaaagtatgttttgacataattggcccaaagaacaatggtgaaaatatttagcaagtgagctcactgtaagttggactattagggaagactttctggaagaagcaagattaaaactcttgtgttgaagggtggataaaattagatgaattgaagatagaggtgaaaccatttcaagtgataacagtgctttgatcagaataatcaaaaatatcaaagctctgtcttggttcactgcagataggggaaaatgcacatatatgacaggaagtactatggctacattttatagtcttatgtgctatgaagtatgtaatcatagcacataagaatgaatcactattttgtaatccttaaaaataaattatttccttcaaaatatgtatgactcagcaaactatctacaggactttttctcctaaggaaataatgatggatatatgctaatatttgtaagaatgtgtctcatcctagcagggcaattggaaataactccagtgtttgatcatatagggcttagttatataaaatcaactgcatcaatactggggaccctgtgcaatctccaaaaaagatttcaacctttgctactaaaacgtgatctgtggaccaatattttcacctatacctggaacttgttaagattcagtttctgatgtagtaggtctgggggagcgcctgagattatgcatttccaacaagttctccagtgattcgcacatgcattaacatttgagaagcagaggcacatgattaatgacatggaaagatatttgcaattaaatgaaatagggtgatttcataattagttccatatgatactatattggtaaattttaaaaaatatgcatacattcacacataagagaaggaaatagggaaagagagagagagagtgtgtgtatgtgcaagacagacagatgggaagaatacatattaaaataccaacagtggtggaattactggaaattatttaaatttttttcctgtgtttgtgtatttgcatctattatgaacatgcctctttcaaaatataaataataaaactatattttcaattccttttctgttttcagaattttactgagttctttctggaaaaataaacaggaaccaagaggctgaactggaagaaaacaactcacaactcacagggatttaatcaatgtaacaagaaactgtcagaagagagaaagacttaaaagataagaattttccactaagtgtgaaggaggtctgtgtaaccttcatgtccctagtgctcttggaatttattttaaaaaccaaactttttttttttttttttttaagtaaggctataaagctccaggagcatagacattttcaaaactgccaactgggaaagtactttcaggatgaaacagatcggtttcccttaacaagtatttctagtggtattactctgagttctggttgggaatattccagcaatgtcacttagaagttgaaagaggacccagctgctttgtcagaatgattctttgcctgccttctcccttggaaaatttaccttaatctttattcatttctgtgagttgtccccatttgggtgatccctttgttctcagcatatgatggtaagaaaaggattcagattccagcttcactatttctttgctgctgggatatttaggcaatggaagtaagttaagatgattaaatgacataatgcaaataatgattaaatgacataatgcaaataagacatttattataaaggaaatacttaaaaagttgactgattgggaactggcattgtggcgtgactatgaggactctctggggaaagatcaactggtcccaaacagaactgaagaagaagctgttcaaccacctgtgggtattgaactgggagtggtgtctgaggtactgggtggttggggctgtgatagaccaggggctgctcatgcagcaccacctcaagaagtgggcatccagtgcatgtaccaacattactctgtccaggaagaagcacagaaaacttctccagcagatccagcttgcccagaaagagaaggcagccatggaagtggaagccccccaaaactagccaggactagtgagccacagctcaaaaggcaaaagaggacaaaagccccctaggatgaagaaatgaaggacctttgaacatctttatttctgccttcatttcgttatgtacccagtagtcattcaggagcaggttgttcagtttccatgtagttgagcggttttgaatgagtttcttaatcctgagttctagtttgattgccctgtggtctgagagacagtttgttataatttctgttcttttacatttgctgaggagagctttacttccaactatgtggtcaattttggaataggtgtggtgtggtgctgaaaagaatgtatattctgttgatttggggtggagagttctgtagatgtctattaggtctgcttggtgcagagctgagttcaattcctgggtatccttgttaactttctgtctcgttgatctgtctaatgttgacagtggggtgttaaagtctcccattattattgtgtgggagtccaagtctctttgtaggtcactaaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatctttctccatccttttatattgagcctatgtgtgtctctgcatgtgagatgggtttcctgaacacagcacactgatgggtcttgaatcttttttttttttttttttgagacggagtttcgctctgtcgcccatgctggagtgcagtggcgcgatctcgactcactgcaagctccgcctcccgggttcacgccattctcctgcctcagcctcccgtgtagctgggactacaggcacgcgccaccatgcccggctaatttttgtatttttagtagagacggggtttcaccgtgttagccaggatggtctcgatctcctgacctcgtgatccgctcgtctcggcctcccaaagtgctgggattacaggcgtgagccaccgcgcccggccgggtcttgattctttatccaatttgccaaggagaacaaagacacaacataccagaacctctgggacacattcaaagcagtgtgtagagggaaatttatagcaataaatgcccacaagagaaagcaggaaagatccaaaattgacaccctaacatcacaattaaaagaactagaaaagcaagagcaaacacattcaaaagctagcggaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaagaaaagagagaagaatcaaatagacgcaataaaaaatgacaaaggggatatcaccaccgatcccacagaaatacaaactaccatcagagaatactacaaacacctctatgcaaataaactagaaaatctagaagaaatggataaattcctcgacacatacaccctcccaagactaaaccaggaagaagttgaatctctgaatagaccaataacaggctctgaaattgtggcaataatcaatagcttacgaaccaaaaaaagtccaggaccagatggattcacagccgaattctaccagaggtacaaggaggagctggtaccattccttctgaaactattccaatcaatagaaaaagagggaatcctccctaactcattttattaggccagcatcatcctgataccaaagcctggcagagacacaaccaaaaaagaattttagaccagtatccttgatgaacgttgatgcaaaaatcctcaataaaatactggcaaaccaaatccagcagcacatcaaaaagcttatccaccatgatcaagtgggcttcatccctgggatgcaagactggttcaacatacgaaaatcaataaatgtaatccagcatataaacagaaccaaagacaaaaaccacatgattatctcaatagatgcagaaaaggcctttgacaaaattcaacaacccttcatgcttaaaactctcaataaattaggtattgatgggatgtatctcaaaataataagagctatctatgacaaacccacagccaatatcatactgaatgggcaaaaactggaagcattccctttgaaagctggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgactgtgtatctataaaaccccattgtctcagccctaaatctccttaagctgataagcaaattcagcaaagtcacaggatagaaaatcaatgtgcaaaaatcacaagcattcttatataccaataacagacaaacagagagccaaatcatgagtgaactcccattcaccattgcttcaaagagaatgaaatacctaggaatccaacttacaggggatgtgaaggacctcttcaagcagaactacaaaccactgctcaaggaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcctgcatcaccaagtcaaccccaagtcaaaagaacaaagctggagccatcacgctacctgacttcaaactatactgcaaggctacagtaaccaaaacagcatggtactggtaccaaaacagagatatagaccaatggaacagaacagagcccttagaaataatgccacatatctacaaccatctgatttttgacaaacctgacaaaaacaagcaatggggaaaggattccctatttaataaatggtgctgggaaaactggctagccatatggagaaagctgaaactggatcccttccttacatcttatacaaaaattaattcaagatggattaaagacttacatgttagacctaaaaccataaaaaccctagaagaaaacctaggcaataacattcaggacataggcatgggcaaggactgcatgtctaaaacaccaaaagcaatggcaacaaaagccaaaattgacaaatgggatctaattaaactaaagagcttctgcacagcaaaagaaactaccatcatagtgaatggcaacctacaaaatgggagaaaattttcgcaacctactcatctgacaaagggctaatatccagaatctacaatgaactcaaacaaatttacaagaaaaaaacaaacaacccatcaaaaagggggcgaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacactttcacactgttggtgggactgtaaactagttcaactattgtggaagtcagtgtggcaattccttggggatctagaacaagaaataccatttgacccagccatcccattactgggtatatacccaaaggattataaatcatgccgttataaagacacatgcacacgtatgtttattgcggcactattcacaatagcaaagacttggaaccaacccaaatgtccaacaacgatagactggattaagaaaatgtggcacatatacaccatggaatactatgcagccataaaaaatgaagagttcatgtcctttgtagggacatggatgaaactggacaccatcattctcagcaaactatcgcaaggacaaaaaaccaaacaccgcatgttctcactcataggtgctgaacaatgagaacacatggacacaggaaggggaaatcacactctggggactgttgtggtgtggggggtggggggagggatagcattaggagatatacctaatgctaaatgaggagttaatgggtgcagcacaacaacatggcacatgtatacatatgtaactaacctgcacattgtgcacatgtaccctaaagcttaaagtataataataataaaataaaataaaaaaagaaatgaaggaccttgaagatgagagctaaacctcttcctctagaagattctcaactggatccagaaggactcagtggttgtttcagaggactttggcaaaagcagtgccccttttcactcaccagatttcctcctccctaatcctcctgtggaaggatgtctttgggagagaagagggtacagaagaaagattggagaggggcctctttacaagtcaactccatttgtaataaagccctagcactctgaaaaaatttttttgactgattaattcatcattcaacaactgtgtaccatgtgaccatcatctgcccctatgggtagaggatgcaaatgatcccagacatgtttccttacctcaagatgctttcaggtaaggggacataaccaaggaaaacacaattacctgcagtgtcacaagtgccatgacaaggagagggcccggtatcacaggggcaaataagaggagtactagccctatcaggggggtggtggcggtaaagaagtcttcctcactgaagtgacatctacattgagatataatggaccagtaggtctcggccaggaatagctgagaagttccagacagtgggaataacacatttacaggttcaaatatgagaaagaacacaaatgttcaggtgctcaacaaactaaaagtgctaggatatgagtctggggaggaaggtgggggcagtagaaagaaggaaaatgatatgagggatctgtagagcctggtcatgaatgggccttgtcagccatgcggaggaagtttcacttcatccaaaaggctgtgggaaagatcagggtcaaatatggtctcatgggggttttaggcagatcgctctggccacaggtcgagaaagactagagacaagccaggaggactgcaaatcagccagctaggagggtgctgcaggaacacagggacaaatgatcctaccctcaagccagtgaaatggatgactatacatgaaatgagattggtgattaactggaagttgggagatgatggaacagactcagagaatgtacttaataaatgcctattttcttttcttctccatagagatctattggccacttcaggccaaggaaagattaacccagtagtagcagaaaaaatattttctagaagcaaaataactgtgtgcttagcagttctgtaagtaaggtctgggaattcttgagggtcactgcatttctatttgaggggtctgtgaggtcaaaactattttcataacaattctaagatgctgtttgccttttttgcttttattctttcacaaacatgcagtggattcttccagaggctacatgatgtgtgataatgcaattgctctgacggctaaagttgtatgtgcttggattttcttgagctttaaattagtcccagttttaatttcaaatatagtaaatacagaaagatacagtcctcatgacaaaagctctttggggtcctcaataatgcttaagagtgtaaaagaaacctgaagccacaaaatttgacaaccaatgccataaacatttaaagaacattttaaaggcatccactaccaaaagcttaaaaaaattatgagtgaggataaactctactgattgaggagcctaattcttatcttagttttgttgtcctttcaaatctgagccattgctggcttgatataaagataatgcctaggatttcatttctagaagaacacatccaactaacaaaatcaaagcacataccatacaatgtactaagtagaaatatgaaatccatgtccgcaattctgaatatactttcttctttaaacttatttttaaagttggaaaacagagtcactgagtaatactcataccttagaacaaaatctctgttgtgtaggcagaaaagcaaaatagaagcgataatgtgggcaagtggaaaataacacagtgaggagaaatgatacaaactagactcagaaccagagctctaaacgcaagttgccaacccaaaaggacttcaggatcccctatgaaccattatttcaaaaaacaagggcagttggctagccaatcaagcataaatctggtagtcatccacacatcatttggagaggcctggagacaatggaggacagttttctgtgcccctgaacaataccaaagtggctgcccttccaagatgtcagtaggtgtctcagcacaaaaagtctggggaaggtcaggataagagcaatacagaaaacggctccagagactgaggtcagtcagttccacgtttaggacgaggattccatatggctgttaggaatgtgatgtggctagtacactggaggaactgaatgcttaattttatttcattttcactaacataaattcaaagagccatgagtctagtaatgaccacactcgagaactctattccagaactttagtgaaatgatctttgcaacctgtggagagccaactataagatctcccatcatggtgcaagatgggtttgaatgtacttttcaggtaaacacatatgtgaaatccttgtttcccaccaaaacccattcagctgcctaggacatctgccagcaaagccagctagttctccttggggagtttggaataggagcttagtaaagagggaagcagagcagacaaatgagaggcaggagtcttgcctgttaccctatgtgacctggccctgagctatcttccaaattcttttcctgatctgtagctgcttgtcactgtgctccagcgacacacaccctctagttcttcctagaatataccaagcaagttcccatctcatggcctgttgtgtttatttactttcttcttatcctggaatgctctttctctggatcagggtttcttaacttcagtgctagtgacattttaagctggataattctttgctacagggacctgccctctgcagcatagggtgtttagcagcatccttgttctctatccaccagatgccagtaccatacttaccccagttgtgacaattaaaaacttctccagacaccaaatgtccctggagaggcaaagtcaccctggttgagaatcactgccctagatatctgcatgattcactttctcacttaatttagttctgtactcagatgtcacctccagggaatctttttcaaaaccctacacctctctgtcccctttccctgttttatttttcttcccagtatttatcactagctaacatcatatcagatacttctttgtttcttgtttctttgcctgctttatttactgctgtatgctagcacctagtatctagttgattggtagatgctttataaatatttattgcatgaatgaaggaaggaagtacctgcgccatttgtaaagtcaaaagagagacaggaagtttgcattctgggagaatggacacatgtcacaagcagaaaagctgtaagtcaatttagctattaaaatctgtattggttgttatataacaatgataaggctttagcacattttctaataatgggcatacttttactgaccttctctaaaattatgctttgaatgcgaaaataaattataattttaaatgtatttgtcaaccacttttatgaatagtatgcaagtttgagacctaaaattgcggtcatttcatatcatcaagaatctatgttcttacctgattttaacattgatgtctatttgcctttgagcaaaagaccttttgataatgagaagaagtcctgatgaaaggcctgcattttccttcatagttataaattgaaaatgtgtttccaagaggtttttattagcattactgagtgtaagcctatcaattcagtaactccagccctaggaaatttaatcatgtgctgaagtccttacttactggtaagattgagatttttttttccccccgatgatttgttataatctttctgaattcctcaagaatactagatgaatttataagatgctgactttcttctggaagaactgtaaatattcaaaagaaattacaagcaccaagtaaattgcacattttggagactaagggaagaaaatccccaaactgttggtagatggtcagagtattctcctacaacctggatctagccaattattaaatgaagttccataatacctcagttcctaaaaatctccggggactaagaacttctggatatattaactagaatttttaaaagttaagtaaatctactttcacattttcaaggtttttactgatgaaagtctttctacaacaacacacactgctatcctttttaataatagaaaatctggaactctgcgtgtgtgtgtgacctatggccacccttttgtgaagctgtgcatatgcacaaacaagggtgggtgcaagtctcagaattaggaccccaaaggtggccctacaagttgattcctcttccagatggggtgcagcactcgcagaaccataaaggcagcatcccaagcctgccttgtaaaaaaactgactgctgaatcaaaaaccaagagcagcccttccctttcagggttatcttgattctttaaaataaaacaaaataaaataaaataaaataaatcgccatctttacttctgtttctagagtctcgtcaacttttcagtagtcctctaaaccttgtttgtgatttgtacagtcagccattttggcaacccacatcacttaccttttcccttcactatttgtatggaggagaagcattccttatgagtcatttgagtattaaaaaattttttttgcgtatatctatttaagatatacaacatgatgttatgaaatacatatatagagtaaaatggtcattacagtgaaacaaattaagatatctatcatgtcacagttatccatttttcccctctgtggcaagggcagctataatctactcatttagcaagtatcctgaatacagtatgctcttattaactatagtctttatgtcgtacattagatctttagacatgtttgccctacatatctgctactttgtagagtagaggattaacagtggttctcaggggtggggtggagaggaagcaaatggagagatgtaagtcaaatgatacaaagtaatccaagaatttatgtgagaagaagtgggaaaagtctatttctaaggtgcctcaacctttccccctaactccatccttaccaccaccaccaccaccaaacaccgtaataataataataataatcaggaaattaacacttctaaacacctgatgccagactacattgtttttgaagtatttcccaatgtcaagctttgaacagaattatagatacctacaaaatacattttcatgaacaagtttgagtgttttgtatagtatttgcaaggaatatcagagtcctcttgtattttcttttataatattttgctttctgaaaaatatctcagttgatacactgacaggcagaaagatgatcaaagatattaaccctgccccttcaagattagagtcataattgcctagctggagagggaccgagtatcctcaagtaggactcaggtttgaaataatatttccctgaaggtacaaaaaaatgatggaaccccttgggaagtattccacatccatctgtgtattagcttgttctttggaatcaacattatggctcctcagatacctctgtgctaaggatttttttctgaaagtcgaaagttttatttttctacaagaccactccctgtaggcacagtcaacctgtcctcattgtgtttgaacccaggtacagtccacaaataagctggcaaatgtgaccaaggcacaccattacatgctcctcagagggctggagggtacttataaatgcattctcttgaagaaagaagcaattggcaatttttatacagctgcattatatgctgattatgtacaaagcctaaaaccaggcaaagtacctagcagaaaatacccatgcattattcaactaatacaaatctgttgtttttctaatttgctcttccaaacatgtcttttcaagttcttttgagttgcagttgttttgaagtgggggagaagaaaagttttctctcttttcagggacaaaaactcaaataaaagaggtacccccattcagctaatcatggcagctttaacaatatatgggcaaaatatacaacttacaaaattagaggctttatgaagagcctccctttataaccaagttattttagaacagagaaagataaataatctacttatcaggctaggttttccaggctttcccattccaagtcactctatgttttctttccttctttttctatttctcccttttgcctttcctaatccatatcgcaagataccatgtgcaacacgctcacccctatttaactgcacctgttcacagtattctacagtcaaaagctctacttttgcagcaactttttattgatgaatgcattttatcctgattacatgacaatgatgatggcttattcattatttcattcagcatacttattgtgggcttactatgtgccaggaattgtgtgggtcccaatgatagatagaacagggttcctagcttcatggagctcccattcactggttaactacatgtatgaaggctttcagtaaattttgtttgcagtgacattctcctgtgatcccaggggagatctgatttatcctcacatcaaatatgactctcctgaacaacacggtggtgttcttttagggctgatgtcttatatttgcctttaggccaatcatatcttaagagactgctgagacctagaatagctttttgataagcccctttgcctacctcccctatctgaccctttctttcttacaggctcttggtgtttacagtttatagccactatcatcatccccattcccatagtctcttttcctttcctattcttctgttgtttgccacatgttttctgcttttttatctttcttttgtcttggccatatctgaatgctttcagtctggtccatcaatggcactactataatctctgagtttccaggtcttcttagttactattgttatttttgtatgctcaaaggctgggtaaaatattctttacaacacacattcattggttccaccactgctcctttctcccccatcaaacatagttcagtgctattccagatgtttgaagctgtttgtgatctgatatctgagttctggataatgaactactgcagctcactttgccagagacagtgagagttcttcccgacatatgaggtggactcacaatatttgataagatgtagaggcagaattagaaggtaacagttaatgactagcatcctggaaaacaggccaaagggctccaagttttgcagtgtatttctatgcaaacttgagcatattgtgctggttcactgattctcaagttttcagaaaagaaaatgggaatgttagatcacaaagagagatacactaaggttccacaggaagaagatgcctcacaagtagcccagtacactccagtttattttgaaatggtgatggaatgaaatggttaggtaagtttagttctttgattaaccgagaattaccatatgcactatagatgaatttctaatttttaaataatcaggataaaatgcatttatcaataaaaagttgctgccaaagtggttgcctcagaggtcactaagaacataacaaccaaaaaatcctattgatttgtctttttaaaagagttatagaaaaatggaagtctatacaaagccatctacattctaatgttaaactactcaacaataaagttacatagcatcctgttcacttgttctgggcctaatctattgcttgagattctaaattttttagctgacttttaaattattttcttagttgttttgtacaccttctcctctttttgctatgactaaaatcatctgaagcctcttgcagtgattatactggagtaggcttttccattaaagggtcatcaaataattagttcttcagtgaccccactaaatgaaaattccactaaaaactttagttacaagaagaaaatcctacatgtgttaagatctaatcagattgggatgtctaaagacaaatataatggctagatgatttaaaacttttttttttttttttttttaaaacggagtctcgctctgtcgcccaggctggagtgcagtggcgcaatctcagctcactgcaacctccgcctcccaggttcaagcgattctcctgcctcagcctcctgagtagctgggattacaggcacatgctgccacacccggctaatttttgtatttttagtagagatgggatttctccctgttggtaaggctggtgtcgaactgctgaccttgtgatctgcctgccttggcctcccaaagtgctgggattacaggcttaagctaccatgcctggctgatttaacactttttttttttttttttttttttttttagacagggtctggctctgtcaccaaggctggagtgcagtggtgcaatcgcagctcactgcaacctctgcctcccaggctccagccattgtcccacctcagcctcctgagtagctgagactacaggtgtgcaccaccatgcctggctattttttttttttttttttttttttgtaatttttgtagaaacagggtttcaccatgttgcccaggctggtctcgaaatcctgagctcaagcaattggcccgccttggcctcacaaagtgtggagattacaggcatgagccactgcgcccagccaatttaacactcttatagcatcacacgttactttgactgacacctgtggttcttactggcagccaggcttatggtcactgcatcacggacactgaatgactagacctcgacatgaatctcatacatgttcaaatgcttatgtaaagtttcctgtgggaaggctttcttttagttcattgaaagatgacccattttcagtcctcttcaacttctggaactttaaagtgtggtgtcaacttatttccctcatgactctctctgaatttatgctggtttcttgccgtttgagattttagagctggtctgtgaaagtgggacacatttcccttgacacatttcaaactatttgagaaagaagaatccaggtgcaataagctgtcacactgaatattagaagaaagcaatcaagtcctttgtaaaaggagtctcagtcacctctcttctacctctacttcatataataccacaaattgcaaggctcctgaggaatcttccttctgggtataaactgctaagactttattgcttgaagaagttttctgggggcatagcttgctagcctggtgctcatagtcacaagacactcttttccttggttactagcattgagctttgggtaggagcatctcattattcctctggggacttattacaacactcttgtcaccaaattagtagataagaaagtgtggctaagatgttaaaaccttgaagataatttgctacctggttgtaatttctttagcactattattcttgttcttgtctgacctagactactccacatcatgttttgctttatctgagttctttacaacactctcagagaggagttctgcctttaaccatattgcttcctagacttttgttgtacagagtgagagctgaggctgagaaatgagaggaactggactgcttgagagtttgcacttaaaacctccattaacgatagaggagaaagggcccagaaagttgagatgcagagcagagaaagaaggaaccagcctgggttgcacttaggaatttatggaaagtttcatttttaaaattaaggtcaaatcttgagtacttacaagaatatcagcaagttcactgattaaataaaaggaatttcaaactagacaaacttcatataactacctagatgtctgagaaggtttttatctcatgtttttatttatccttttgaatcatgctctctttgggtttccattagttgcacataatagaattgatcacacctagaaactgtgttcatcaatgcacacacaaaatatatacatacattgttatgtgattgcaagcaaaccacagtagctttcatggtctcagtcttcaactgaggtaactctgaagtccttccaaatcccactgaaactctatgatatgattcacataatgaaatttctacagaggctgggaagtgacataaatgaatgaactaggctggaggtaaaccggaaaggctatgttgctagtactattaggttggtgcacaagtaattgtggttttcaccattaaaagtaagtaccaacctaatatgatcaagaaatgtaggtaaccctttctttgctatattgccttttttctattaaaaatttaaatttgtaatttattattatctttaatttcaacgtgtacctccactatctaaaataaaagctgaaaatattacatcttaagaactcctgggtgtgccccacaaaacccaaccacactgatctggggctttggggacatcactttgacttattcttagaatctacaatagtttaccagacactgtgaaagagctgcaaaagatggtacacaaactgttcaacaatggcgtggagaagaaagtgctgagacaccatggtctgaaaattcaaggtggaatttcacagtgaacacacggattatgagccctgaatgaattcctaactggtccctgagcgttgttaaactgtggaactgctagaagaaagctgtagctgtccatggtgcttaagaattttcctcaatgctggagtcttggagtctgtggtatggaaatactttacactgaacatattgtatattaacaattacaatgacaacccccccccccaaaaaaaatcaccttgatgtggctcaagaggattcaatgtatttctgactcatctcaataacaaacacttaaatagaaactcatattcttgattttctttttgtagttctaaaacaatttgtgtatatgtggaatgatgtgtgtgtgtgtgtgtgtgtgtgtgtgtgtgtgtgtgtgtgtgttgtatctctaaaagcttctaccagcatcacatatttccttgatgttaatattttcaagatttgattgtctacattcccaaagtatagtgcttgacacaagtgactgtttaggtaccagcaattctgctgtggagtgtgtacaggaatatcagtttctgatccttcttcccataagtttaactctatggtaacaattaccttttataaatttaagaaaaatcactgttgttcaaagtaatgggatttaaaattcctcagaataaactaaaaagaaagaaagaagttgaaaaatcacatctaatccccaaaatttccaactctgaaaatcccgctttaaaaatacaactcacctggtttattttaaaatgaaacatcaattctgtatattcatagagacccagagcaaaatgatttcagctggatttcagttacagtaacccttttcatcataaatattctaaaatgctgaccctctgttgatactggctagaggaatttttgtgtgtatttgaaattacttattattttggagccagtgctttaatttgactggtgcaccaacaacaaaagaagagaagacagaaatatgtgttccaatataactaaacattaaagtcttctttcctttttcacaatgaagttttaaaagctttaaccatgagatgataaatctgataaaatcagggcaattaataaagaaattaaataataaatgaaaagaaatcttaaaagcattaaaataggaggctctttaaagtgtcatttaatctccatcatttcagatgctttatgtgtcttcatcacatcattcctatgactttctaatgaaacagttctatggtcctcctaaattaatcattccaacacataacagccttcattttgagaatagtttcatcctatttaatctttgccatataaactttatttcctttgtgagcctttatgtttgtgtattgatagagaaaacgttgtcattattcttcacataactgaaaagtcactaaattagtgaggttcattgctttttttcagataaatagacctcatattttcaaactctctttgtctgtcttttactctccatcttctaatataaggttattttgcataatacttttccaaattcctcataccccattggttaggcaatccctcctgagaggggaaagcatcctagagactacctgtcagatgctattatagttttcgtacatgttacttccatggtcatgctcaaatccaaatggaaattacagagaagagtatttaagtagttctatgtatagtaggaagtgggtgctaatagatttccttaggtgaaaaaacctggatttcagaatgctgaaacagaggaaatcagataccatcttcaagagtgttcttttggaaagtttatgggattatcaattctcttgaagtaataaaaatataactcttcatagctgttaattgagctgaactgagaatgctaggttcaacatatattttggtatcactttaaaataaaaatattatgactttctatataataacaaataaaaatcctgtctcctttggcactattacatctttgacagaaaagctgaaaatagttgattaatatttggtttgtaattctgatggtatacctaaaaagtgcaggataagtcaagataatctttaaaggaatcatggggtatttatcgaaaagaaccagttaataatgttacaagatgcccattaggcacaggcatgtgaattaggttctctgggaagttaagaaataggatattaaaaaaaaaaaaccacgatattcaatccctatcttcaaggtactaacttttaacttgaagagcctatgcaacggaaattccagtgtcagcatcatatgacaaaacaaaaaagaagatgacccccaaacaatcttagcacatatgtattgttgactttggctgggaaggacaggcagaaggagaaatgtcaaagagtttctagagcatttggaggtgctagacccaggtgaagctcgtatggaaagacagattttgactgatgttgtgaaaggctattttcttgtcctaatagaatctggaaggtcacctctgaaagtaatgaaattctttctgcactgcaataagattgttcaatttttaattcaaggaaaatcccaaagcaaacagcacataaaatattggggcttgggggtggtagtgataaaattatcatcaacatttaaagacctgtcaatctaagcatgcacatggatccattttaaaataaattatattgtttttcaatgacagatgccatttttatcatgcacattcctgcaatttaatttacaataaatctccaaatagcttaaggcaattattttaggtagtgctttatctagcagtcatgtcatttgctttcttattctatttttgttgcacagatgtgaaggagttttaatgtatttcatatttctgctaacaataaagaaaaataagatgcaccaaaaaagaatgagcccacaggacatctggtactctcacctcatttaaaaaaaatatttaatacaggtgtttgtattccaaccattctatcatattccatttaatttacagtcaaggttccccaccaaaccgtcttaagccataagctgtgtctttcatcgtctcataatgactttaacatagactctgtgaaataagcaatttttgccatatgactttaggatcgagtataacactagaagggactccaagaaatatcggggctattaccttgtgtcccagtatagttgaatcagatatggacatgtcatttactgtcttattcatagaattcttcttgaaatctaatttcaggagaatttctagtaataattaataatagaagtccagggccagaagcaaagagagaaaaaaaattatagcaaaatttgcaactcaaaaagtttttttctacatcatacttcaggacagtagttaacaaaaaaagcttaattggacaaacattttttgagagtctactagatactgagtgctgtataaggtatgtctctgttgatgtgagcattttgccatactattttttattaaaatttacatttgttggaatgcatttaactatttatatgcctttaatttataacctaactcatgatataatctgatttgtgctacactcataataatgtcaacaccattataatttttgccataatctcataatttaatttcctatatagtgatatcaatactgacacatttgttccacctgggacagaatgttaatgcttttggagaagaatttaagagcaagtccttctggaagacttcttttttggataattcagaactacaaagtttggtggatacagaatcatgattaatctcacacttggttaagtgcatagctgatgttgctcaatcagacttaataaggaatgctaggaagagaatgatgcttctacacagcagcatgtgataacagctgttttccaaacatgacacaataagagcaagtcattatctttgagaaaggtgatgccttcaaagattaaaattcaataaatatttgaaagacaactttgcacaattttgatttgtaaaagatgaactggggaaatgtctaaacaacttgacatgccttttgccttttttggagtgtgggtagaggttgggaggagaccctgctaaaagctaacattattaatacaaggtctgatattttacttccttttcagtaaaataatgccaagtgtctttatgacatttgtaaacggagaacattcagcttatgcccaatctaattacctccagttgcttttaattccaatatacccacattatgaagttcaggaaaaattcattcttagtttaaaaagggaaataaaaaatatttaaagtctttcaatttctggtttatgcacaaattttgacatatttagaaattcaaacctctttgaaaccaataaggcgtatttcaaacacaaacaccagttagattagataccattaaagggagactaataagcaaactacagttaaatccaaaatcctacacaacctcaagcgccagtcaaatctcacctcttccttgtagcctccccaacactccttgccagaggagctcacgtgcttcaaaacctttccagcgctggtctgcaccatccaaaacctctgtcttatactgtagttatatttattcagtactgtacatgccagtggggtaattttgtacccctagaggcatttttcaatgtcttgggacatatttgattgtcccaactggagagtgcgtgtgctaccagcatctagaaggtggagaccagagataccgctaaagatccacagtgctcaggtaattccccccacaacaaagaaatggtgctcgggctgagaaaccctgattatatcctgcacactgtacatctggtaagtggttaattttatattgcacgttataattacatataactcaatcagttgttttctcagtagctaaaagagtgaatgccaatccaaatgtgcctcctccagaataagtaagtagtttaggtaagaatttggctcaacattttatttttattctatcttggcttaggatgacatgcatacaaactctgttgaatgttttgataaaaactttcagagttggaggtaaactgtcttcataataagctattttcctagggcttcgttatatacagcacagcatttttttacagcattttattttatgtgcacatttatttttgccactttttaaaggaaatatgtgcaagaatataatgagacggtatatgaataaagattgcagcattaaaaatacatataaaggccaccatgactgcaatttttcatgagtgagaatttggtgagaatagtttacatgctctcctcaatgtttctaaagacacaacactgaatggaagtaatatggacccacagatcagcactcaatgtagcatatcttagaacagctttttccttactcccaggatacacagctgctgcccatattcccctctggggtacagttatgtcagacttgaaagaaaaacccaattcctgctctgccctggtccttttatatccagacgtatagagcattggggaaaaaaagtatgctttcagtatacaggcttcttattaacaaggaatatttataaacactgtgacctcctgattcctgaagcaaactcagctctagcgaggccacatcctcactgaagaatgaaagcggagtcaaggcctatgagccctgatcaagatttctgcctgcagctttatagttcctcaaaaaccagtctccctggagtcacctctttgcgcacaaacatttcacacagaacattgcgtaggattatactttctctcaataggtagtcttcttgctgcagtaataacattctaattgcctggaaaggaatataacttcaagagtatatgcaaccaaaaggtaaaagtaaaagacaaaatcaggttctataaactctagttctatattttcgtgtgtgcgaatgtgtataagcttgtgttattctcatttatgttgattttgtttgttcatcttgttttattttaataagaaagcaaataaaattgcagtgtggttccaaagagcaatcagaaagcacagcactccctgcacaacaggaaaaggaacagaagagaaggttgtgattggctcctggagacctcagcaaccttctccaaactgaacagagtataaaatgtgattttgctctcttcataatgattatcaaattcctgttggctaatacaattatttggcactaaatatcctctacttgtcatgcatatgactcacttaaaatcattacaggatggcattattcacatatggttaacatagctaaattcatttgcagtttaccaactgttctatagaatatttttgcaccctgtagaattgatctatcccaaggcatattcaacgtgatatacacagcctttcttttcttttacaccaacggaggattttaggctggctttaaagttctaatgaatgctcctgggtacattttgttttttccttcatgtcagaaagatggtattttatttatccctaggtagtacatgttagatcatcatactgtcagagacctctgtgaagtcaatcccagatttattgcttgttcccatttccttcaagcacctacaacatttgggctgaaacttcgtcatgattaaagaagcaaagattgtatcaccttatttatcaggaaagaaaagaaagcagttctgtgtctgtgggctctaccattcctaggttcttcctatcaagcaaatctgctggcatttaatgctatggcctcagtttaagttgacatacatattagacatttttatgtggataaaaccaaagaagagggggatctgtatacagtgatattttgatcatcacccatgaaacaaaaaaagaatattttagatataatccaaatttttgaaaagtggccttaaataacttacatcacattaagccggtgatcattttgcattagagttttaattctccccactatcttccctaactcatttttccccatagcattttgcactctcctacacactacatcatttagttatttattttgtactgtcttccctcccctacaagaagggaagctccaagcaggcagggattttggccagttttgttccctgcaggagctcagacacttagaacaatgactagcatgtggcagacactcgtacctgtttgttggatgaatgaatatgacatcttccactctttctccaattattttttaggcattcaagtaattttgctataaatccttttccagaagaaagaactttttaaaattaatttatcttaagtgtggaaaagaagactctgaaaaaatatcctatagtaatttaccttacatccctctcagcaaaggtctgatcagttttacatttatttaaaaacatggttatttacttttgaaaatcagaaactacaaatcgagatcatttctatctctttctcagaggggaaaggggctacttccagtctttgtggtatatccctaaaagttcattaaagtgaaagaaagcaggttaaccctgaggacctaaacagctctgggaggtcagtgttatcagcccttttcaagtgaaatggctgaggctcacaggcttccactgcttgccaggtaaggaagtggggactgggagtgggattaggtgtgtcggctgtggaggccatgacctttctgatccgtagtcagacacattatccatggcacaactggcctttacccaaggctgtgccctttctaagagcagcagttccactccaggaccaaggcgtacagttcctctatctcttgggtatttaaggttttcagaaaggcagatggtctcacttgagttgcttcgtatgactggcatttttaatgaattagtgacagaaaaaaaaaaaaaaacttgactcactcccagctggataacttcacaaatgccaagctgaaaggaatgatatctcataaattcaggcaaatgggcattaaggggactaagctggctgttcttttaatataccgagtattagcattttccagggcttcaggtcggtaatgcagtttcagctcaggagactacacctttcattaaaactcttttattctttctgctttgctataatgaaaaaatcttaacctgtcacacctgtagtgattatagaagggtctcaactctggtggggagagaagctcagaacaggcatgtataattttcaaagaccacataactgcttcaaaaaaaatgacagctgtcaccaacattttacatccaaaaacaagtttaattgttcagactggtgttttaaaaagctccagttattggaaggctcctcaatttttgtatagccagagactcaaataactctaggctagaaggttttatttactgatgagagagggcatattcaatatcaaaaaattgtcatttttatttgtttgcattgaggctgagactaaaaagccaagcagcacaccaaaaggagaaaatttactgtatgcaaattaaaagctaaaataattgcctgccatgaaaagaaaagtgaagcacaggagcctgaggtaggccatatttgacttactcatctttagaacaatcttaatgcccatcgtttcaccttccacatagtaaatagtaaatgtctggtgcatgaataagaataagaggaactgaatagacatttctcaaaataagatatactaatggccagcaaatatatgaaaaaatgctccacatcactgatcagggaaacgcagatcaaaaccacaaggaagtatcatttcaccccagttaggatggctattatcaaaaagacaaaaaataacaaatgctggtagtgactcttatacactgttagtaggaatgttaaccagtacggccgctatggaaaatagtatggaggttcctccaaaaactacaaataggaccactgtatgatccagcaatcccactattgggcatttatccaaaagaaaggaaagaagtgtattgaagagatatctgcactccatatttattgcagcactattcacaacaatgaagatatgcactaaacctaggtgtccaataacaggtgaatggataaagaaaatgtgttgtacatacaaaatggaatactattcagccataaaaagaatggaatcctgtcatccacagcaatgtggatggaacttgaggataagtgaaataagccaggagcagaaagttaaacagcacatgttctcacgcatatgtagaagctaagaaaaaaagggggtgatctcatagaagtaaaaagaagaaaagaggatacaagaggctggatagggaaggaggaagggagggctagagagagatttattaaaggatataaaattagagctagagacctggaataagttctagtgctctatctcaactatagaatgcctatagttaaaaatatgttagatagtttcaagtagctagaagaaggatattagacattaccaacacaaaaaaataatacatgtttgagatgatggatatgttaattaccctgatctgattactatacattattatatggatctaaacatcactaggtaccctatgaatatgtaccattatcatttgtcaattgaaaacgtaaaattaaaaaaaaatagaaaagtactgccatttaaatgaatgaatgccaggtcactttacccaaggctgcagggtacccacagcagcacaggtgtctccctcacttccttcaggcctctgaacaagtgtcaccaaagagaaggtacagaatgcagtgagaaccatgacaatatttcattgcctttaatgtagaatgagtctttggaaaatatttgaatgtgaaaatttatcttgaaggtaacttggcaatatgtatcaagatcagtaatgtgcaggcttttgacacagtaattgcatttatcctacagataaattacatagttatatttgtaggataaataattacataaatatatgataattatttaacgtatatatttatctgtccatgtatacagaggtagaattacaaagatgttcaatgttatatttttgtgattatagaaaacaacctaaattgcccaccagtaggcgaacagttaaatgacttcacaaccttaagaatgctaggccattatttcacaaaatgaggtaagtttatacatagcaacatgaaaacatatctaacttatatattaaatttaaaaagctagttgtagaattttatatctagtttaagagtcattgttttattgcttagaatacacacatatgtatattgacaatggttttcatccctttattgcctgaattgctaaaatatgaatatattacttttgcattaaaaatttaaacatgcttaaaatatttttcgatgcatatattttctaagcataaatgactacatttaaagtcacatttaatagtgtttaaatcatcactcctactcctttctacacttaaatcctataactcttaggtttttttttttacctttgataataaaattttttgacaatggaaaaaaagatattcatctttcaagcacctgacctacttaaaactgtcacacttttcagttcattttgcttcatagtccatttgttcaaatgctaagtgataattgatttgtcttgagttcatctttcaaaataagccagcataaaacaaactagtatacaacataaggcagctgataaatcaagtttagcaattcttctcatttatatattgtctcgatatcaagccccaaataaactttagaaggtggtctagctggtggaaaaaatatgaattttagaattatgatttatgtttgaatcctgtctctgtcataaactactagtataacttatcttctctgagcttcagtttctccatctgtaaaatacatttcttgtgaggattatacataatgctatggactgaatgtttgtgtaccaaccccacccacattcaaatgttgaagctctaacccccaatgtaactgtatttgaagatagtataaagaagtaatttaagttaaatacaatcataagggtggggctttgatctaatatttgtgtccctataaaaagagacacttaagaacacttgtttctctctctctctctctccgtgtgtgtgtgtgtgtgtgtgtgtgtgcatgtgtgcacatgcacacaggctatacaagaaaacagcaagaagttgaacatctatgagctagaagaaaccaaatcagtggataccttgatcttggacttccagcctccagtactgtgagacatagatttctgccgtttaagccacccagtctgtggtattttcttatagcagcccaagctgactaatacatgtagcataggtaaaacatcaaatataataccaagtacagggttgacaccaaataaatggtgactgcaggctgcccacacttttctttgcacagcaacctgttagcaggacctcacacatactggaactgtgttctcactttgcctggcagcgtaacctatacattgtgagccagtttgtccaaccacttgagcaaatattatctcttttgtctgtgaaatgagtatgacaatatctaccagggttgtgaggatttgaaaacatggaggagaagcactgagattgggttggcacatggcaggtgctcaaaaatgatacctattgctgtgttttttatggatgtccaatataagaccttaaagaactccttgttttgttaaaaaaaaaactcttcctggtgaacttttagacagaactgcaaaagggcaggtgcaaatatttgtccagctatggtcagcccagcccctgacccctagtgggcacattatgtctgctgccaaaactttccaagtggtttagcccccctggctggcattgaagaggcagaggttgtgggattaatttccacagtctgattagctttcagagaaaactctgacttgtagcttggaatgtcatagtggcctgagaccacctcttgaaaaaatactagcaatactggctattaaagagcatgagaaccccaacccatgcaactccatcagggctggcagcctttcttatttttttaaattaattaatttctttttgattgacaaataattgtgtatatttacggggcacagtgtgatgttgtgatctatgcataaattgtagaaagattcaatcaagctaaggaacatatgcaatgtcttaatgaggctttggcaatgtcagtcatacattagtatataatcctaacgtcgcaatctgagagctacctctcccccgtgtctgtgctggttctccctctgcagccactttgccaatcacatttcaaatgcagaacccaggcctgcctgtctcagggcagaccatgaaacagagacactggctgccagggtcacttttgattgcagggccagctgccctcccatctgcctgtcaggctggagaaaaggctgagaattgaaaatgtgaaaataatgcagccccagtgtaaaaaaaaatccagatttttcaattgccattctgcgagtaaaacctaggaattaacctgtggcctttttgttttattgtttcataaatgagtaatagctagagggaggtatcccttagaccatttcaggcccaattgctacagagaagaaaatgatactatgaagtcacataaggatgacacattttagaagtcttaagatgtgactcttttttttttttttaaacacgctgggcatgtgagctaccttctggatggtatcttggtccaagtttccagaactactgccctttggtgcctgagtctcaatgatggggagaacagggcactataaattcagaggctctggatttagaattttcttggaacaattcggtatacctgttatttgtgaatgcatttcacatcatttggatattgtcagaacattactgacctaagggtatcagaatcaaagctcttgattttcttcagcccagaatgcctcaccagcaagatgatcttctttccgttctcttacaatatccccttcagtcatccagcccattgcctcctcacacctttaagtgaaaacaggtctgatttccaatgacaatctgtgaaggaagcctacagagaacgcagcttgctgcacccagcatgaagactagcacagcactcacacctcgctcagcacccaggatttgcacaggtgttcaggaagcattgaatgaatgaaaaatcatgaatagaggaaatctgcccacttagttatttctggagtgatcctggtatctcttccaagttttcttgttataaaaataatcttacttgtggtttgcagaagttctccaatgtcctctggacccctgattttctcattcttaagactcaatggttgtctctgttgggcacctctgacctacgtttgtggtttaacatatatttattgagtgccttctctgggccaaacctttgtgaacaaggtagaaaactcccgtacttttgaagcttatattctaatgctacagatgggcaaaaacaaataaatactcttatttcaggtaataagtccaggaagaaaaacaaaacagaataagggaatggaaaagaaaggggtggggtgaggttactttaattatgatgatagaggcaagtctctctgaggaagtaacatttaagcagagactaaatagaacagtttagggatgttcttaactacatgcagggatgtagttagaattaaaatatgtgtagccagttttcccagcaccatttattaaatagggaatcctttccccattgcttgtttttgtcaggtttgtcaaagatcagatagttgtagatatgtggcattatttctgatggctctgttctgttccattggtctatatctctgttttggtaccagtaccatgctgttttggttactgtagccttgtagtatagtttgaagtcaggtagcgtgatgcctccagctttgttcttttggcttcggattgacttggcaatgcgggctcttttttggttccatatgaactttaaagtagttttttccaattctgtgaagaaaggcattggtagcttgatggggatggcattgaatctataaattaccttgggcagtatggccattttcacaatattgattcttcctatccatgagcatggaatgttcttccctttgtttgtaccctcttttacttcgttgagcagtggtttgtagttctccttgaagaggtccttcacatcccttgtaagctggattcctaggtattttattctctttgaagaattgtgaatgggagttcactcatgatttggctgtttgtctgttattggtgtataagaatgcttgtgatttttgcacattgattttgtatcccgagactttgctgaagttgcctatcagcttaaggagattttgggctgagatgatgggttttctagccatatgtagaaagctgaaactggatcccttccttacaccttatacaaaaattaattctagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaaccaccatcagagtgaacaggcaacctacagaatgggagaaaatttttgcaatctatccatctgacaatgggctgatatccagaatctacaaagaactcaaacaaatttacaggaaaaaaaaaaccccatcaacaagtgggcaaagtatatgaacagacacttctcaaaagaagacatttatgcagccaaaagacacatgaaaagacactcatcatcactggccatcagagaaatgcaaatcaaaaccacaacgagataccatctcacaccagttagaatggcaatcattaaaaagtcaggaaacaacaggtgctggagaggacgtggagaaataggaacactttcacactgttggtgggactgtaaactagttcaaccattgtggaagtcagtgtggcgattcctcagggatctagaactagaaataccatttgacccagccatcccattactgggtatatacccaaaggattataaatcatgctgctgtaaagacacatgcacatgtatgtttattgcggcactattcacgacagcaaagacttggaaccaacccaaatgtccaacaatgataagactagattaagaaaatgtggcacatatacaccatggaatactatgcagccataaaaaatgatgagttcatgtcctttgtagggacatggatgaagctggaaaccatcattctcagcaaactatcgcaaggacaaaaaaccaaacaccgcatgttctcattcataggtgggaattgaacaatgagaacacatggacacaggaaggggaacatcacacactagggcctgttgtggggtggggggaagggggaggatagcattaggagatatacctaatgtaaatgacgagttaatgagtgcagcacaacaacatggcacatgtatacatatgtaacaaacctgtacgttgtgcacatgtaccccaaaacttaaagtataaaaaaaaagaattaaaatatgtgataacagtaacgcaaacagtgggagagatttaagtgaaattaaaatattctgagattcttagtacatgctgtctggaaaatggtaaaagtactcatttatattgggcttttgtaagttaagcatgcattatatgttctctacaattttaataacggaataataaaatagggatgggaaacaaaatataataataatacttgattaatccaaagagtagcaaaaaaaggagagaaaaataatatagtctcagtaagagaaaacagatgatggatttaaaccccaaatatacccaaaattacatcaaatgcaaattgattaaatctaattaactgattataaacaaaacagtgcaatcagtacccaatcacctgcagcttacaagagatacattttgaatataagagcttgaaaatgttgcaaggatagaaaattctagataaacattaaccaaaagaagtctggtttagcaatactgaaattagacaaagtagactttaaagccataagaatttctagaaatcaagaccaggccaggcatgatgcatcatgcctgtaatgccagcactttgagaggctgaagtggggagatcacttgaggccaggagttcaagactagcctgggcaacatagtgagaccctcgtctctaaaaataaaagtaaaaataaaaataaaactagccaagtgtggtcgtgtgcacctgtaatcttagctactcagcaggctgaggcaggaggatcccttgagaccaggagtttaaaattatagtaagctatgatcatgccactgtacttcagcctgggtgaaagagtaagaccctgtcttaaaagaaataatcttataccatgcaagagttaacccatcatgatgatgtaataattctcaatttataatgtctaataacatagcttcaaaaaagacaaagcaaaaattaactgaactaaatgggaaacagacaaatctgcaaatatagtgggaaattttaatacacttctgccaggaattgatagagcaagcaaaagaaatcagtattgaacaaataatatttgaagaacatgatggacaaggacatctgctaccttttcctctttgcagcactgcactaagaactttgccagacacatctaggcccatttgcggggacaggggcatgaagacagatagaggtccacattctacatatctgaatgtgttaatttaataaatttaagaagctaagaaaactgtcaaaatatattttcttctccttccttgacaaatatatcttcatggtaacaaaataaaattatgattattgtttatatatgactgaaaattagcaaaatgtcaaagattattatatttaattattatgaaacatgcatgggtgttctgttgatggccatgtgtgaatgatggtgtcataaaacaaaggcatgaataacccaccactattacatatttattttacaaagtatttcccatgcctttattttagcaaatttatctcgttacaataagatatccatataatcggtacactactaacagtaatgatttaaaaggttaaaaaataaaatgcaattgcattcaaggtgtatacattttgatatatttttataaaaaataagaaacatctagaatatcaaaaaattattttttcaggtttaaaaatgctgtttttctaaaatattcaacattatacgttaaaattaaaggcaagatgcaaataaattactgagtttcaaaattttaaatcaatattaagaaaatatgacatttaaaatttggttttaaaaaatttaatgaattttattaaatatttttataaaaatgaaactttttcagttctaacatggaatgtccttctatatgccaatgaaaagaatcaccatgaagcttcacaaatgttaggtctggaagtaaatatatgaaaatttaagaataacataaattgtttcatactgcaaaatattgctcagatggcatacacaattactcaaaaaatgttgctaatttacgaataacttgctgatcttcaaaattaaaaatcagaatgcaagatgagtgaggaaaaaaagctcagacctactgggagtcaatactatacttcattatgcaaggaatctatgtagtcatgctatctaggaggataaatttgtcaagttaatttgtcttttaccttagtgcttctgtcactacagtcttctttcatggaaaagcagtgtttgtccccactatcaacataagcacaacttataaactttcatggcatctggatgttgttacattttgtttcaaaactgtagggcaagagatatggagaaatgtttttctggagtgggggctggatgatgttagggtaaaagtggacatttagggtaacagatcccgagagagagagaacgcatgcattctttaataaatgtattgtggtcagtgggtggatttgtgatatgttggtctaaaagtggtatcagttttaaccaaaacaataaagcaaaaaagaaaaagaaatgaaaggattagaaaggcagaaataaagctgtcataatattcagaaaatatggctgtatatatagaaaagtatcattattattttcaaataaactatttgaattaataactaaattctatagaatttcatcatgtgaatatactacaatttatttattcattctaccattgatgtacaattaggttgtttccaactcttggctattacaaacaaattctcagtaaatcaattatatttccatatacaagccaaaaacagaagatgaaaaaattaaaaaatattttatttaaaataacataaaaatcatatatctagccaggcgtggtggctcatgcctgtgatcccagcactttgggaggctgaggcgggcagatcaagaggtcaggagttccagaccagcctggccaatatggtgaaatcccacctctactaataatacaaaaattagccaggcatggtggtgcgcaccggtagtcccagctactcatgaggctgaggcagaagaatcacttgaaccaagaaggtggaggttgcagtgagccgagatcgtgccactgcactccatccggggtgacagagtgagactctgttccctccccaaaaaatcatttatctaggaataaatctaatcaaaaatgtgcatgactgctacaaaaaactacattatttacagaaaacaaagaagtctaaatcaatggaaatatacaaaatgcttatgaacagagattctatattgtaaataagtcatttctactcattaaattatagttgaatgcaattctactcaaaattctatcaggtaatttgaaagttgacaagctaatttaaaatttatttgaaaatttaaaaggccaaaaagaatcaagaaagttctgaagaagaacagaactcagtaatgtataccatcagatatctcaatctttattacaattaaaataagatggtattagcagaaggacatacaaacagagaaaccagaaacaaactcatacttataccatcacctgatttatgacaaaggtgaaactgcagtgcagtgaggaaataataatcttttcaataaatagtagatcacttggatattgatatgcgggaagaaaagaatttcacccctatcttacgtcataaacaaaggtcaattgtaggtggattataaagctaaatgtaaaaggttaataattttaaaaaagcttctataacacaggtgaatatctttatgacattggggtagacaaaaatttcttaaacaagactaaataagcattaactatacagaaaaagtctgataaattggactacgttaaaactaagaactttatattaacaaagtcaccattaagagaaagaaaaggcaagttagactgggagaagatatctgcagtgtttatgtccaatataatatctatatccagaatatataaagaactcctacaaatcaattacagaatatattcaaagagccaattaagcatcagaaaatgtgctcatcaagggcaggcaactcaaagtgacaatggggtaccatgacacgctgaccagaccggtcaaaatgaaaaatacagacaatgccaagtgatggcaaggatatagagcaattagaactggtgaaggtaaaatagtacaaccactttgaaaaattcttaggcagtatttaataaagttgaatatatacgtatcctaagacccagcaattccattcatggtatgtacccaacagaaatgcatacaagtgtgtaccaaaagacatgtataacaatgttcatagtagcattatttgtaatagtcaagagctggaaataagccaattgtacatcaatggtagaatggatgaataaattgtagtgtattcttacaatgaaatactatagagcaataaaaataaaactatggctatatgcaacaacatgaataaatcttaccaacaacgttagataaatgaagtcaaaccccaaaatgcacatattctatgaatccacatatgcaaagttcacaataggtgacagtggctactcctttgggaagcagtgaggaaagaactaagagagtactacagagggggctctgggtgtctgtaatttctatttcccaatccaggtggggtttacatgaacatgttactttgtgaaaattcattgagctgtaactaaacatctggaattatttatgaatgaaattatatataactcaatgggaagctgggaggatagggaggaggtatgggggctaaagaaaacatggagtggccaaatgcttacaattgttattgctgggttacggatacctgggtgtttgtttcactattctttccattttgtgtatatttgaaattttccattataaaaaggaccaaaaaaaaaaaaagagagagagaaaactattcacagagacccacaacagcctcatcatggtttttactggcctctctcactgaaccattgaatcacagttttattggctttatctgaaggtaaacatacactgtggaaatggaatgtcatttgagggcaagcattaagatgttgctatcctctgtatgtccttcctggcacctagaatgctgtctcacccttcctgggcacttaaaggtttggtttctgctgctgccatcagctaatcttgcctgaaaaattgtgtgctattgattccgctcttgcctcttgactccaaacccactcttgtattttcaggctttgtgacacttgagaggatattttgcaaaccacgctcctgatttgccagttggctttccggttctgccaaaaaggggagctagagggaagtgggaagcctgtaggaaaaagaaggaagaggtttgcttcttcctttttacttcctgtgcacttcctgtttcctgattttttgggattcgtcccagaggttgcattgccttctcttcacagcaggtgaattcaatggcgcagtttttccaacactcacataacagcctcaacactctctgctccaagtaccagctgagcagctccctcctcaagtttccatgttttaataattctagccttttctctttgaccctccaggcctaggagtggcagctgcttcctgcaattctacctccctgggacctgaaagttgttttacactttagataattaacaactttctacctagttaacaattcatgttaagcatgctctgttgaagatgtgagttctgcctccagaatgggtcttgactgacacaacctccaagagttatatactctgtccttgctgcctgtgtgatgacatacaatttgttgattattttctcttattgagcatacatttgtgtaaaaaatcaacagcttttgcttcttatccccaccccatgtaagcagaacagcaatttcaattatttgaaaattcagctatctcaatttatattttaaaatatgactattgaaaattaaataattgagttttgctttaataataatgtagttagtatagtatgcaatgggacaatttttgacaaagtatatctgagcataagccacacatctctcacaggttcacactatttcttttaaagctctccattgtgaatgaaactgatacagcaatatttgaaattcagaggccaaaaagccaaattctatctcagaagcaattgccataaaagtgttgatgtcataagcatatgaaagccacaaggtagctgcttaattgaaaagcagatgagaggaaagctgcattttacatgaataaatactgccacaaacaaagagcaccctgttaagaatttaggcaaaatgtgctgtggaaagatggacaggtattatcctaaggaaataatacagtaaatgacaatgaattcatctggattagactatttcatattagcagtctgttctcagttgcccatcctttcagaaggtgtgaagaccagaaataagaccctcaatagtagatacagaaattatcttcttaaactgatagataatgccctaagttaggaacttcaggagagaaaagcctatgtttaaattttcctgagatcatgaggttcacattcaatgaatcccccatacctgttcttaaatttttttttaagtataggaaggttggaacctttccttagtttaagtgtataataagtggcaaaagagggattagaccctggtcttctgattcagggcctggccctcctttcatgaaggttctctagttagcattagaacatgccttcttcaggaacaaggccaactaaaaagcaacctgtgaaagaaatcaatgaactatcccctacctccacatacatacacctgtcctcaggaatgtctctcacaggacatctggatcaactggactctaatgggccacaaacatacctctaatgttgagaaactgtcactacctttggaatggctgaatgcttcatggaaccatcttgttttgtttggagggaaacaatggagactatttaccagcagatagagatcccagagggaaatgggaatttccaattaaaagtagaggatccttatgttactgtttcgatgacgggcttaggaaaatttaagtgtctctgatatttccctaagtctgaaaaaactgttattttgaaaaatggaggaattgtgtgcttaacaactatcttacaagacaacagcttgtaaaaattaaaaagtaaaaattggttccactgtctgcatcacatcagcattagaagactgagctaagaaagtagttacggctgagttggacaactacagctgaggttatgtcatagggttagtcagtttatcacttctattcatagtgaacttgatcatacactgatgtgtaatccaccttataaattatagagaattttaattagctgctttttaaggaaacagtatttgaaatacagctagcaccaattttctgcaattcttaaagcaaagataatttaccgtactataagcttaaatttgaagaatgaatgttctttcagtggcatttctgaaactttgctattgacctaggttaggggacagaatgggtgtgctgtcggggctgggcagaggagtgtagcccagagcagttactgcgcagtacaatttatttgaagctggtgttatattcaaaaagagagaaagattttgcattctataatatgttcttgttcacataacataaaatattctgaattacttgctaagtaaattatttaactgctgccctcctttaaaatatctaccaataaaattaagctcaggtcctagggttctgtttatcctgaggcacactactgcctctcccaattcaaaaagcatggacatttagacgcaattcttggcactatagatactctacagaaggatggatcaacagtataaatggacgggtacctggttttggtgggggtgcaggtaaggaggatactttctcactttattagcccatgtataaactgtggggttatgtttatttgattgcttagtggcttaaaatgaaaaatagctttgtgcccttaagagaccaaaacccagtcctgatcatcaccgcaaccactcacgctgcacaacattgttagaggggaccccccacagtatacctcacctcatatgggctggcagagctgctctgtgatgttacaatacatcaatgacaccaaactttctcttattttccctaggacctatgccctcctctcttaggttcagaagagggtcttgtccatattactgagaggataaagatcatcatctttaattcaaaatactgcttccttgacttctatgttttctattttctccctcaccatatctagggatggatgttcccatttcttcttcaagccacctctcgcactgtgtgcttgatcccatctccttcttcctctttctggtccttgctcatgttatgatcacaacactccagcatcttcagttcttctctatcctcacactgggagtttgtatgtttaccttgttagattttatggttgcagactcctatgctcgtagaggactggtgagtcatcaaagaagggaaggaccagacaggggttgtttaacccaaagcatatgccccaaggaaaggggacagccgctacttggctccaactgatgttgtcacatggaaaggaagaccccaagttgtatgattttccaaaagtagatgggaatctggatttacatatgaaatctggtaagttttaaatgttgactacaatttaaaaaattgaacactgtggcttgtttcactgtggatgaaacaaatacttcattagccccaactataagtttcacctatccatctaaacattcattttactctgcttcccattcaaataccttgttacttcactcataaacttcccaaacatctaagcctgtaactattggcttcttttccacatccacggttctctccttatccaacttcaatatgtttcccactcttctgaaagtgtattcttgaaggtcactaggaagtttctaactagttgatatggtctggacatttgtcatccaaatctcctgttgaaatgtgacctagcatgttggaggggatcctagtgggaggtgctggatcacagggacagatctcttatgaatggcttagtgccatccctttggtattgagtgagttcttgcactgagttcatgtgagatctggtcatttaagattgtggcacctgctccacccctcttgctctgatgcacctgctcccttagccttctgccatggttgaaagattcctgaggcccttcccagaagcagatgactgtgccatacttcttgtacagcttgcagaaccatgagccaattaaacctcttttctttgtaaattacccagcctcgggtattccttcatgcaatgcaaatagactaacacaccactgaatactctggaatacttgtgtgtatgtacatatctccatacatccttaaaacaatagtttcaaggagtgattccaagagaagtaatatcagcattgtctgggggacctgctagaactgcagaatttcatgcctcttccaagacctaataaatcagaaactctgggggtagattcagcaatctatgcgttgataagcatccaaggcgattgtgatggctgcaagtttcagaaccactgccttaaaatatacctacctgtgagtgtacctgttgccagagagcaattaatctatccctctgaattttgccccacagcttcaattccttttctacatgctgggaaagacctgcattgatataacactttttattaaatgttttttcatattttattacctaactcctataaataagaactttacacaataggcaaagcaagtcaaaaaagtttattatgcccatctaaccatcatatgtaaatgtaaaagcagcaataagagattaagtgactttcttaaaatcatagttaggaaagtgtcagagttaatatcaatctagtttcctgacatatcatagccctttctttctgtgttttagaaatactatttttttctacttgtaagagtctaatacattagttgaagaaatgctggaaaatacagaaaagactacagaagaaagtaaaaaatcatccagaattctaccactgacatcatgcatttccctcctccaatctgtttttttttctctctttttttttttaaatgcacaagtgcatgtgagtgcagatgcaatcctctttcaattacaggacacaacactgtcaggaggtaagcggctctcttgttctcagtgcctacgacaactttccgatgggaccataaataagaaatttaaataattattttatttatcttttgttcatcagagctctacgtaactccaaaagcagatgcaaaatctaagtgaaatgaaatcagcattgctgacttttattatagccatgacatacaggaaaaattgctaatcccttatgaaaatattcaatatctctatgctcttaggggtgcctgaggcaactcctagtgcagatagcatgtggagtctcatggtgactaactgtaattgaattcaataaaaaactccattatcataatagtctagggtgtcaataaaattgatacttctataataggaaaaatataaaatatacccaagggcatacaatgggaagcttttaattattattattgatccagagaattatttttccctgattctggcattactctgaaatccagtatttctgtcctcacttgtttatctccctttaaaaagctaaggtcaaaaagtctaaagaaaattcatgggcaggccaaactaagtgctatttctgacaaataacatttatttggtgcttatttttagtcacacttatcttgttgatttatgagacagctagcaagaacctttgcaaaagtgttttgagttccttttgggggttcttataggagtccctaacctgctagatctgtatttcagaatgtaattccaacaatgaaatcaacaattttatttcagagcaatacaaaggaaaaaagccaactaacaagaacaatcccagttgttgagtgtctactgtgggccagtactatgctggtactctccaaatcattagagtataacctctttttaaaattacaaaatattttaaacactcaaaatggcatacagaatgatataataaccaacaatcaatctactacctgatttattcaaattttaatatttttaatattcacacttacttgaaagaagtaaaatactccagatacatgtcaagccctctgtgttccctcttcattccacttctctctctccctttcctcaccatcctgagtttgatatctatcattcccatgtactttttatgcctatactttctctctctcccattatatacatatacaggtatgtgtacgtgtttaaaacatttctataataggtttcataaaatacacacacaatttgcttgtttttgctgtgttacattatgcaagtccttatacatatacttaatctctttaggcctcaatctcttcatctgtaaaagagggataataatcctacatagaagaggactaactaatactgataaagtgctcagcacagtggctagcatgtaatcagcatttaatagaagttagtcatatacatattattatctgacatatcactttgcctttcaagagattagccaaaggaaattcttcttgtcttacctggaaattaacttttactatgagtgtcttctctaactcatatatttctacctgctccatgtgacacaggacagatcaaatgcaaatgtgtcaccatagactgcttgaacacacttgtgatggcacagacatgtacatacacacaccacacacacgaaggctaaccatgtgacaggaagtgactggagctgctctgggtcaatccatttcacccacacatatcagtgaggtgttttgattattttcattttatatatgaggaaactgaggcacaaagaggttaataaactgccagagatcacaaagttagcaaatactatcatggcaagatgctctatgcaagcagtcctgctcctgagtgtgtgctaagggctgacactcagttgcctcttgactcttagcctatacagattttcctatttgctggttctgcaaaattcgtaagttcactaaagagatatgcaatagtgaatatcatgtgtgttcccaggttatttattgaattatttaccaaaagcaaatatccaaagccatttgttctgggcaggggctcacactcagctcagctgaagcagatataaagatactatgcaggagagcagatctgtgatttcagttgcctgagtactcctattaatacaagaaaaaattcccattgcactcatgcaagccagcaggcacattttcctctttaccatgagacttgtttctttatactcaacaagatgacaaaacattaatcccttccctctgaaaagtataacacaagaagttttagactggcctccattgatgtagtggggtaagtggtggaagaaattgttgagtcaccattgtgagcacgtttaatgaaagatctgtgagtcacagctgggcagtaagattgtgcagaatgaatgcctgcacaatcttaggtgggttaatgttaaaattatgatcgttgtggtttaacctgataataaatttccagcaatattggtcagtcccttcatctaggcagcctaggcccagatgtttttattgtcccttttttgatttttttgtttgtttgtttgtttgttggttggttggttttaacaacacagctaaagacatcctcctggcttcctgatagcactggcctcaccagaagtgataaagcattcctagaaacggaaggaaggatgaatcacaaagtacagttcagccacagaggagggtgataagcaacccttctttgtttcaaatggagacagctcaggaggaagttggtttgtgttaaattagaaacaacaagagcctcctcctatctggaacaggttgctgtaccagattgtgtaagttccttctctctagagaccttgaagtacaggataagacacatttgatcagcacaaccagcttccagagttatttccagatgccatcataagcccctgaggttctcatgaatcagcaaaattgctttgggcattctagataccgacccaagttacctctcttttttgctctcagctcaggttgcttaggtgagaaaggttaaaatagacaacaaaaagatacacaatccatatctcttgaatcctcagcaaaacacaggcattcaattcttttaaaatgagataaaagaacagcatacatttcatttattttggcttgtcttcctgttagaatactattaaaccaaccagaatcttttttgaccatatttttatatttggttggatgtccattttttaaaaaggtatttgtgtgtatgttcaaaggataaaacaaagaccaccagagattaaaaagaaaacaagacaaaactgagtttattgcctgtgggataagggagaaccagagctcagccacatcatccaagaaatgagtttagctggtctcttcctgtgctaaagacaaaagggactgcttatttcttactagaagagattctaggcattataagaaatgttcaacgtagattaaatttaggggtagccatatttagcaaataaaaattcaagatgctcagctaaatttgcattgcagataaacaatgaatcatttttagtatgtcccaaatattgcatgggataaacttacgctaaaaaatgactccttgtataatgaaaaacgaaacttacctagcatctcatattttatctggcaactcgaattagtgggactcagtggggtttggggtcatgcagcagcagctagtccatatgctcacaactgggacttgctaacatttttctttaacagtgtaaagtaaatgtcacactgcagtgcattctgctaaagggaccataaaccaaattctcccacctgggatcacccgttgtgatcaagtccagaggaatataccaagttggagagcaaagcacatgcctgctagaccctccaggaactcaagccaaggtcagaggaactgcagttgcccatgcttcccagaccaggagaatcagttgctggacactgccggagtacattagtgtcagaaggtggttcaaagaagtctttgaagacaacttcagtttttagcttgtaaagctgactggaagataatgttttaactgaggtccagaatacaggaagattcactgggaataccagaaaggcccaggggccactgcaatctctttctgtcctccccagttgcctaatgaacacttctatttaagcatcctctgcttggatatcctacagttcttaaactcaacatgctcaacactcaattcaccctcttcctctccaaacccatttgtcctcccataattcccaactcaactacagatagcatgcgaagactctaacagccccaggctagaagtctccaagtcatctccaaatgccactgccccctcatactgcaactaatcaaatgccaattccttttgatactatgtctcctttagttcaagtcatcattgtctctgatctcaacaacagcaaaagggtctgaactgagctctgcccccgtccagccattttcccttttggtgtactcttttcatcgatatctttataaaatgcaattttgagaatgtttctctatttctaaagtacctcagcagcttttcatgcctagaggataaaatccaaatgccttcggggagacacaaaggtccttcaaggtctggctttggtctgtttccagcttctcgaccatcactttcccccaacaacagatggtgccaagctaccggccaggtgtctgccatctgatgctcttccacatcaagatgactttgcacagacagttcctgtacctggaatgtcctctgcctactctgcttttgtctggcaaactcactgaagaccctgctctagtgttagaccggcttctggtaagccggcttccttctcgactgaagatttagctgcacccctagtttgtatacccacagcattctgtgcctgccttcactatggggcttactgttttatgctgactgtgttcggtaacatgtttgtcttcctcgtaggattatgaacctgggggagggaatatgccttatttgctttgaacccctatgacttcacttagcgctgacggtaataattatagcagtaaaagttattgtagccaacactatgtgctggacatttttctgggggctctttatccatcttaacttgttaatcctcacaacaaccctaggaggccagagctactatcatgtccatatgacagagaaagaaagcaaggcagagatgtgaaaggcggccaaagtactatatagttagtaaaccggtggtttccaaatcacctacaaagtagaagcacctgagaatattttttcaaaatttaaaagtcttgagtgggttccagcccactggagaaccactgaagctgaatttttggtgggctgggacctggaggatcctattaaactttcccaggtgattttactgtgcagccagccttgagaaccactgatctcaagttcctaagaaacttcagccaatgctggggagaaaggagagaaaccaaatcattttttggggaaaaaagggatgcagacatggggagtagagagttccatagctctgcagccatggccccaagtgtcccaccaagcatgagacttgtaggtgagcagagtaccaggctcacctgatatgccaatctgcccttcctgaacattacggataggaccatggctctttctttagcaaatatgtgtctggaggatcagacgtaggaagggtggtggagctggctcctttctaacttggcagtgcactttaccaagagatagaagaagacttggctgaattaggcatttctgagcacaggcattataattctgcctaatcttcaaagacagaatgaacttgtcctgctcctttctatgtaccagctgcttctctgcaaagaaatcattcattccttccctcaaattagaatgtacaatgtggtagccactttccacgtagtcaaaaggttgtcaaatggcagaattagacctgaaaatgttcatttgatgagtgcttgcgacacgtttgcttatgtgtcatcagcgctagatgctttccagggaagaaataagaacggaaactagagagaagaggtgcagaaagaatgaggacttgatccaggatggagctaggtagaacagggatttttcttggtagatagaaatatacagtaactcaccctaggaaagggtgagttactgcagatctcatcagcagtggtcaaacatggggcaacaatgtgggcttatgaggtgatggacagatcaattccgactcgaacaccaaggggttatggcagaatctgaatgagaaaaaatgaagattccctatgactggagaaaagaggctgtgtcttcaagggttaagtctgtcaaagcgatcatcatggcagataaggatgccatttaacacagaccatgcagtcacgcaatcctggggagctggaccctggcccagccccttgggagcgccatcacacttggaaaactccttaaactcaccgagcctcagtttcctcctatataaatagacttaataaaaaacctaactcatatggttgtggggaggaagaaataaagagtctgcattaacaataacagctaacactgagagaaagagagagagagagggagaatgaatctatgtgtactcaattcattatatcctcacaacaatcttagacactaggtactattcccatgcccatactacagatgaggaaactcaggaacagagaaattgagtgacttccccaaagtggtatagataataagtggccaagccagattctgacccaaggcaatctagcaccacctgcaatactaggctcctactgcaaaactatgctcaaaattctctatatggattagcagacaaaatgaggacaaatagcagatgcaagaaaaatgcaagggccagaatctctaaggatttcaaaggaggtccctgatccctcaggtgccaggagtaagatttagacctagatccacattttatcatattccgtccttttctttgcatactctagctggatgggccttgaatgaggacacaaaaggcaccgtttgaagtccccagaccactgctggctcctccaactcagcaggcagggaggacaggagcctgcagcagaatcatttctcatctaaccacctctctcaaccagtgctccaccaggcagcacatctgatttctcagattcctcagtcccagcatttgtgaaactggattttatctgtgttgacaatcaataaagcttttaagaatagagacagctcttgttctggagagttctaagtgctggtgagcagatctaagaatgcagaaaaatattaatgaccctcaactattaacattcccaaatagtttgttcattttcatacagttgggtgcttattagtcagactggcacaaaactaatctttatttttaaaccaccatcttcctttagtgttgcattcatttctattttttaagaaatgaattaaatttcattactgtgagcagtagtatctgaatctccaagtttcatgtacccttaggcacttccttgctttaatattttcttattttttccaccaagcacactgttggcctacttggccacctctttagaataagttatattcctttaaaactaccatcccaccaaaggtatgtactagtgagaaaagcaagccaaggaccagatgggcatcctgtgtcacctggatatgtatcggacagggagagcacagcagttccttcagatttctctctgtcacataaagtggcaggggatgagacccacaagcactttctggctccaaaaattggcatctggcagcatctccttccacctgcatcaaactccaagcttcttttagagaaccaagcagtatttttagcagcaaaggtatgaaaatgactgattacatatttgaacatggatacaaaaaagcacacttaaaaaaaattttaaaaactcctatcctttccacaacattaacaatttaaactacactatgaaggtaaaaaagcttactactcagctttcaccaaggtaagccactgaatgaattcctcagagattctgtcaaaggagccacatcctcagtggcagggtagaagaaaggatccgcctgcagccacaggccctgccccactcattgcctccccaggactacagtccactcttctaagagccagtctcttcctgaagccacccgtctatcctccttccccaaggcatgaagagcgtaggacttggagcatgacaatctcatgacagcctggccagccctatttctcactgtgtgaacttaagcacttcaactgaacctttgagccttgaattcttcaatgacagcgggactggtgcccagtgtctattccactttccttctagcatgccttcctgatctgcagaggcttggaaatctgacagtacagatgcccttgcagctgggtgcagggtttatttaggttcagccaatcagacactctcaagctggatttagaaggtgaaagtcaggttagaggctgtgtttctgctctttctcctggaaatcatgggaggattttttttttttttttaataacctgtggtgttttgtaactaggatcctaagcactgaatggcagggccctggtggtggtatgtgccaaaatgcaactccaagcttcttttagagaaccaaaactgtgccaaaatgcacagttccagtggcagcatcccgattcctctcctgctcgacaggcagaagcagctctcttcaggcagaccagttttacagtgaggtccgagacatagcacactgagacctagcctgctccacaggcctttcaatgattttataagcatccaattcctacattaaaacctgatctctctttaaaataataagatggtttctattttctgcaaccgagcctagactgatatacctctctaaccttctgagcaggtataaagactgaaagatgaaaggcaggcaagagagcacagcagttaagaacataagctctgagctcagatggcctgggcttaaatcctggtcccgcctctagcttgatttgcaaccaggggcaagttccttaatctccagtttttacatgatggggatactacaggattacataagataatacatgtagaatccttgccaagtacttggtccctagtaggaattcaatacatgttagttttttcttgtcctaagttctcataggaccctctgtacacttctattattgcagttatcccattgatcaattctctgtgagcacaaacccagaggactgtttatcacatataagtaaaaagtagaacaccccaaattctaatccacgtgacttgggagcaaccttgaagaactgaaaaaaataattgaaacttattaagtgaaaacataattgtatctaccgtactgtgttacggaaatagtgtgaaacaggtggccgggtgtggaagtatgacaaagaggggaaattacagcaagagttggccaggcctgtccaacggtgctgaaggatagaggaaatcttggctgggcaaatgctccattttcctcagtaaggtcatccctgctgtgggtcagagtctatcaagctattttagcaaagcaacacttcttaagtccactacgatgccataatctggctccttagtttgttatctgtagacagccaacgtgctagtcagaacagtcaacttcacagtttaattcctaatcgtaaattaatagattgtcacctggttattataattttactcacctacagtcagatacggcactgattttacctttccatttggttttagcgatgtagctctcattgtattacaatgggctgtaattggatttgtattaatatatagcagtcataatgagcttggttcacataagtccacctaggagagacaatccctttgcagtgagctatcatgatcaggtttatgattccactgggctgagggccaggttcctgaccatggcaaattcaccaagttacctgctacctgctaactgctttgagtgccctgtgtgtccagcaataaccttcaaatttgagcactgaaactgtatacaatgatctgctttcatgtctgtgaaatgaccattcctaaatcagattttacctccaaatgcccagccaggcacatacatagttgatatataataaatatttgatgaatgaatccataaacaaatggatgtgcccttctgcagaggagttttaaaaaaactatagaaatggcaagaaagaaaataaatccaaagggactctgagaagaagagaatcataggcttaaatattttgtggtgattctttgcaaatattcaaagcttagctattgatattctaacatttttggacagctttttatataatgctgttatcatgagtgtattaattttctattgctgctctaacacattaccacaaaatttgatgctgacaacaatatttatatattatcctacagtttctgttgtcagaagtccaggcccagcatggcccagctgggttctctgcttgggcagtcatgtaattatgtgacaactaattcacctttgagaagcactactgattatcctaaagttccagattattctggagctaaaaaccagattttgtctggctccatttcagaccaggctctttgaaagaaactttgacttaagtctgttcacttcaatcggaaaaagatgatgtttctctagtctttctctagcaaatgctcaagtttagggaagtgttttagggagagaaaacgtgacatcagaaatgtataaaactagagcttgatattcacacttcttttactgaagctttttttttttttttttttttttagagacaatggtctgactctgttgcccaggctgcagtaagtggcaccatcattactcactgtagcctcaaactcctgggctcaggcaatcttcctgactcagcctccaaaagcattagggttacaggtgggaggcattgtgcccagcctgaaactttttaaaaacagaaatgcctacctcaaaattctggagtcaattcattcaatttaccaactcacaattgaaacaactgactaatcagatgataacaggttgtaaattccttgaaggcaagactgcgtttcatttgtctctgtaccccgagaactgagcatggggattgttgtgtatttaacatactgtatgtttaataaatttgagacctttggatgaaactaaacatggcagcaaaatacatggctgtataaaaacacttgtcagtagctgaaaaatttcactgattcataaagttagttgccaagaagaaaaaaaattgtaaagcagtttcttttgtttcttcttttctttctcctcctcctcctttgtcttgctttaaattatgttcacctaaaattctagaaggctatttttttctttgttagcaaatagatgcaaagcagaaatagtccaatgataattaaaaattagcttgaggtaagggccaggcccataactgaaataaagaaacatctaaaataccccaataagccagtggaatttcccagtcttttaaagtcacataaaacccagtagagatcttgaaaaagataaagacatactactatcatttatttgtcttcaccaaaattcacgttgaaatttgatcttcagtgtgtgctgaggatgttgggaggtggggtctagtgggaggtgtttgggtcatgggggatggatcccttatgaatggcttagtactatactcttggtagtgagttctccctctggcaagactgtattattactcttgagaatagattagttccctctagagtgggttgttacaaagccagaatgctccttgggtttctctctgcacatgtccacttccccttttaccttctttttcatgttagaaccctgtatgaaagccctccccagaagccagggccatgaccttgaaattcccagcctgtagaaccatgagctaaataaactttttttctttataaattatctagtctcaggtattatgttatagcaacacaaaacagactaagatacataccaacagagaaagtgaagagatttgatcactgcgtctatgctagaataatttttatataaaacaggaaaaactggtttatagaacattaaagaaaataacctacctaccaatagacatggagtcctgtgtctcctgtgacctaccaatagacatggagtccaggctttttgcctgaactaagtctgtgaagaagatagacacagggagtatccatcaaccccagtttcccatcccatcactctttgtttgtccacatgaataggacgtcagcccttctctggagcaggaaaggaggaacaaccataaataacctgtttgtgggatcagaaagttttctaattaggactattctacacaaattctgaactttccttatttattttcagtaggtctttacttaaacaaacaaaaaaaaccccctaagaattagaatataacattatttggaaaactctccttgctataaagcaacaagagatcaaggtttccttcttttgaaagaaccataggagtagtgtatatttgaaaggtttttgaacgggattggcttttgtaagtgtgagggtccaagacgaaagaagaaacttatcaggattggtttgtttttaataaaggaaggtaattccttttaaataatgctatattcagtaagaaagaaatcaagacagtcatttcacttcctgcttatcactgctgtcagtaattcctgctaatcagaaagttggagctagaacacattctcttgttctactaaggtaaagtcgtctgttctccttgattcaatagcttaccccataccgcaatgcaccttccttctgtttctgggatagactgcaaaaagtgcttgcctaactcttttgtgtcaagattgcacagcaatcagtatgcagcctattgatttatgtgaagactctcatcttgccaagcaaagagaaataaagtacaattagcttactttgtgatcctgctgtttacaaagaagatcaaacaaaagacacctacaaacagccacttagatctggaatacaaagcacgatgcttctatttagttcctgattcttaccatgtctgccatatggtagcaagttggcataacctaaataccagagaatcttgttttgaatttctacaaccatatctgggtttctcagtattggtgtccagcccatcaacagatggtgcccagcattttacccattaaacaccatgatctccataaccatttaataatgagattggaccagataagatcaaggaatagattaatattctgcacagattctgccagcttttcaactgcaaagtgaatttatggattgaatcctctgaaattatcccataaaagcagaacaatattctttagtcagttcacaaaacagtgtttggaggaaaatggcagcattgcagccatatggacacttgcacttgaatgataaaattggacaatgtaaaaacagattacttaaaattaattgctgtatctctttaagtaaagaatactctagttgactttggttttgacatcagtcatttactcaataattatttactgggtatctattatttgccaggcactcttttaggcattagggattcatgtgtgaataaaacagatttctgcctgaatgaaacttacagttcactgacttctttctatgtttccaccataaaccatatactggcataaatagggctcctgagaaagtgagtgaaccacccttgaggcccatcaaactccatataaacaccctgctatatccttttgttaaaaaataatgtggccttttaaaataagatagattaatgtttatcatcctgcttcctggcttctcaagcagtacagattttggtaattcaatctgagccacataactttattttgttgaatgttggtgtgatccacagatgattttcaatattcaccaaggaatttttcaatcaaattttggaaatctgttgcctcctattttattgagaaaatagaaacaaaaagacagcttctccaagtcccaccaagacattcacccattacctgtagctgggcaatcactcggctccctccttactattaaaatgtgggcacttgtcagggcctttccatttgtgtgcaggatcccccgcccattccccatccattcaaggacaacgcaccagtaattctccctctcttgaattatcaaatctttcctctgctgtgtaattcccattaccacacaaatgtactataaattttcttacttttatttttttattatactttaaattctgggatacatgtgcagaacgtgcaggtttgttacataggtatacatgtggcatggtggtttgctgcacccatcaacctgtcatctacattaggtatttctcctaatgctatccctccccttgtccctgacccccccaacaggctcctgtgtgatgttcccctccctatgcccatatgttctcattgttcaactcccacttatgaatgagaacatgtggtgtttggttttctgttctggtgttagtttgctgaaaatgatggtttccagcgtcatctatgtccctgcaaaggacattaagtcagtcttttttatggctgcatagtattccatggtgtatatgtgccaccttttttttaatccagcctaacattgatgggcatttgggttggttccaaatgtttgttctatcgcaaggacggaaaaccaaacaccacatgttctcactcataggtggaaattgaacaatgagaacacttggacacagggtggggaacatcacacaccagggcctgttgccgggtggggggagggtggagggttagcattaggagatacacctcacgtaaacgacaagttaaggagtgcatcacaccaacatggcacatgtatacgtatgtaacaaatctgcatgttgtgcacaggtacctttaacttaaagtataataaaaaaataaattaaatttaaaaaaatgtttgctattgtgaacagtgctgcagtaaacatgtgtgcatgtgtctttatagtagaatgatttataatccttagggtatgtacccagtaattagattgctgggtcaaatggtatttctggttctagatccttgaggaatcaccagactatcttctacaatggttgaactaatttacactcccaccaacagtgtaaaaacgttcctatttctcaacatcctctctagcatctgttgtttcctgactttttaatgatcaccattctaagtggcgtgagatggtatctcattgtggttttgatttgcatttctgtaatgaccagtgatgatgagctttttttcatatgtttgttggttgcataaatgtcattttttaatttttttattttattttattttattttattattatactttaagttttagggtacatgtgcacaacgtgcaggtttgttacgtatgtatacatgtgccatgttggtgtgctgcacccattaacttctcatttggcattaggtatatctcctaatgctgtccctcccccctttcccccatcccacaacagtcccatgtgtgatgctccccttcctatgtccacgtgttctcattgttcaattcccacctatgagtgaaaacatgcggtgtttggttttttgtccttgcgatagtttgctgagaatgatggtttccagcttcatccacgtccctacaaaggagatgaactcatcattttttatggctgcatagtattccgtggtgtatatgtgccacattttcttaatccagtctatcgttgttggacatttgggttggttccaagtctttgctgtcgtgaatagtgccgcaataaacatacgtgtgcatgtgtccttatagcagcatgattcataatcctttgggtatatacccagtaatgggatggctgggtcaaatggtatttctagttctagatccctgaggaatcgacacactgacttccacaatggttgaactagtttacagtcccaccaagagtgcaaaagtgtttgagaagtgtctgttcatatcctttgcccactttttgatggggttgtttttttcttgtaaatttgttgaagttccttgtagattctggatattagccctttgtcagattaatagatggcaaacattttctcccattttgtaggttgcctgttcacaccgatgatagtttcttttgctctgcagaagctctttaggttaattagatcccatttgtctattttagcttttgttgccattacttttggtgttttagtcatgaagtctttgcccatgcctatgtcctgaatggtattgcctaggttttcttctagggtttttatggttttaggtcttacgtttaagtctttaatccatcttgagttaatttttgtataaagtgtaaggaaggagtccagtttcagctttctgcatatggctagccagttttcccaacaccatttattaaatagggaattcttcccccattgcttgtttttgtcacatttgtcaaagatcagatggttgtagatgtgtggtgttatttctgaggcctctattctgttccattggtctatatatctgttttggtaccagtaccaagctgttttggttactgtggccttgtagtatagtttgaagtcaggtagcttgatgcctccagctttgttctttttgcttaggattgtcttggctatatgtgcttttttttttttttttttggttccatatgaaatttaaagttgttttttctaattctgtgaagaaagtcaatggtagcttgatgggaatagcattgaatctataaattactatgggcagtatggctgttttcatgatatcgattcttcctatccatgagcacggaatgtttttcccatttgtttgagtcctctcttatttccttgagcagtggtttatagttctccttgaggtggtccttcacatcccttgtaagttgtattcctaggtattttattctctttgtagcaactgtgaatgggagtttgctcatgatttggctgtttgtctattattggtgtataggaatgcttgtgatttttgcacattgattttgtatcctgagactttgctgaagttgtttatcagcttaaggagtttttgagctgagacaatggggttttctaaatatacaatcgtgtcatctgcaaacagagataatttgactttctcttttcctatttgaataccctttgtttctttctcttgcctaattgccctggccagaacttccaatactatgttgaatagcagtggtgagagagggcatcgttgtcttgtgccagttttcaaagggaatgcttccagcttttgtccattcagtatgatattggctgtgagtttgtcataaatagctcttattattttgagatatgttccatcaataccttgtttatggagtgaagcatgaaggggtgttgaattttatcaaaggcctttactgcatctgttgagataatcatgtagttttgtcactggttctgtttatgtgatggattatgtttattgatttgcatatgttgaaccagtcttgcatcccagggatgaagctgacttgatcatggtggataagctttttaatgtgctgctggattcggtttgccagcattttattgaggattttcatattgatgttcatcagggatattggcctgaaattttctttttttgttgtgtctctgccaggttttggtatcaggatgatgctggcctcatagaacgagttagggaggactttctctttttctattgtttggaatagtttcagaaggaatgataccagctcctctttgtacctctggtagaatttggctgtgaatccatctggtcccgggctttttttggttggcaggctattaattattgcctcaatttcagaacttgttattggtctactcagggattcgacttcttcctggtttagtcttgggaggatatatgtgtccaggaatttatccatgtcttctagattttctattttatttgcatagaggtgtttatagtattcttggatggtagtttgtatttctgtggcatcagtggtgatctctcctttatcattttttattgcgtctatttgattcttctctcttttcttctttattagtctggctagcagtctatctactttgttaatctttgcaaaaaaccagctcctggattcactgatttttttgaaggtttttttctgtctttatcttcttcagttctgctctgatcttacttctactggcttttgaatttgtttgctcttgcttctctagttcttttaactgtgatgttagagtgtcaattttggatctttcccactttctcctgtgggcatttagtgctgtgaatttccctctaaacactgcattagctgtgtcccagagattctggtacattgtgtctttgttctcattggtttcaaagaacttatttatttctgtcttaattttgttatttacgcagtagtcattcaggagcaagttattcaatttccatgtaattgtgtggttttgagtgagtttctttatcctgagttctattttgattgcactgtagtcagagagactgttatgatttccattctttagcatttgctgtggagtgttttacttccaattatgtggttgattttagaataagtgctatgtggtgcagagaagaatgtgtattctgttgatctggggtggagagttctgtagatgtctattaggtcctcttggtccatagctgagatcaagtcctgaatatctctgttaattttttgtctcattgatctaatattgacagtggggtgttaaagtctcccactattactgtgtgggagtctaaatctctttgtatgtctctaataacttgctttatgaatctgggtgctcctgtgttgggtgcatatatatttaggatagttagcttttcttgttgcattgatccctttaccattatgtaatgaccttctttgtcttttctgatatttgtttgtataaagtctgttttatcagagactaggattgcaactcctgcttttttttttgctttgcatttgcttagtaaatcttcctgcatccctttattttgagcctatgtatgtatttgcacattagatgggtctcctgaatacagaacaccaatgggtcttgactctttatccaatttgccagtctgtgccttttaattggggaatttagcccgtttacatttaaggttaatattgttatgtgtgaatctgatcctgccattatgatgctaactggttattttgcccattagttgatgcagtttcttcatagtgccgatggtctttacattttggtttgtttttgcagtggctggtacctgattttcctttccatatttagtgcttccttcaggagctcttgtaaggcaggcctggtggtgacaaaatccctcagcgtttgcttgtctgtaaaggattttatttctccttcatgtatgaggcttagtttggctggatatgaaattctgggttgataattcttttctttaagaatgttgaatattggcccccactctcttctggcttgtagggtttctgcagacagaactgctgttagtctgatggcttccctttgtggggaatccaacctttctctcgggctgaccttaacattttttccttcatttcaattttggtgaatctgacatttatgtgttttggggttgctcttctcgaggagtatctttgtggtgttctcagtatttcctgaatttgaatgttggcctgccttgctaggttggggaagttctcctggataatatcctgaagtgtgttttccaattggttccaatctccatgtcactttccggtataccaatcaaatgtaggtttgtttttttcacatagtcccatatttcttggaggctttgttcattccttttcattcttttttctctaatcttgtcttcatgctttatttcattaagttgatcttcaatctctgatatcctttcttccacttgaccagttcggctattgatacttgagtatgcttcacaaagttcttgtgctgtgtttttcagctcagtcaggtcatttatgttcttctctaaagtggttattctggttagcaattcctctaaccttttatcaaggttcttagcttccttgcattgggctagaatatgttcctttagcctggaggagtttgttattacccactttctgaagcttacttctgtcaattcgtcaaactcattctctgtccagttttgttcccttgctggtgaggagttgtgatcctttggaggagaagaggcattctggtttttggaatttttagcctacttgctctgttttttcctcatcttcagggatttatctacctttggtctttgctgttggtgaccttcagatggagtttttgcatggtcatcctttttattgatgttgatgctattgctttctgtttgttagttttcctcctaacagacaggcccctcttctgtaggtctgctggagtttgctgggggtccaatccagaacctgtttgcctgcaccagcagaggctgcagaacagcaaagattgatgcctgctccttctggaagcttcatcccagaggggcacctgccagatgccagccagagttctcctgtatgagttgtctgttgacccctgctgggagctgtctccccttcagaaggcatgagggtcagcgacccacttgaggaggcagtctgtcccttagcagagctcgagtgctgtgctgggagatctgctgctctcttcagagccggcaggcagggacgtttaagtctgctgaagctacgcccacagccaccccttcccccaggtgctctgccccagggagatgggagttttatctataagtccctgactgaggctgctacctttctttcagtgatgccctgcccagagaggagtaatatagagaggcagtctggctacagtgactttgcagtgctgtggtgggctccacccagttagaacttcccagtgactttgtttccactgtgagggaaaaaacgcctactgaagccttagtcacggcaggcacccctcccccgatcaagctcaagtgttccaggtcgacttcagactgctgtgctggtagcgagaatttcaagccagtggatcttagcttgctgggttccatgggtgtgggatctgcttagctagaccacttggctccctggcttcagcccccttttcaggggcatgaacggttttgtctcactggcattccaggcactactgggttaaaaacaaaaaacaaaaaacttctgcagctagctcagtgtctgcccaaatggccgtacaattttgtgcttgaaacccagggcccttgtggtataggcaactgagggaatctcctggtctgcgggttgtgaagaccatgggaaaagggtcgtatctgggccagatagcactgttcctcacagcacagtccctcatggcttcctttgggtaggggagggagttccccaaccccttgtgcttcccaggtaaggtgatgccccaccctgcttctgcttaccctctgtgggctgcatgcactgtctaaccagtcccagtgaggtgaaccgggtacctcagttggaaatacagaaatcacctgccttctgtgttggtcttgctgggaactgcagaccagagctgtttttattcagccaacttgaccaggaacttatctgtaaaatctcttacttttaaaaagaaaaatcacttgatctctgttttagttcatcttttgttggttataaaagaatacttgaaactgggtgatttataaagggaaagaaggaggctgcaaagtccaaggtctagaggctgcacctgctaagagtcttcttgttggtggggactgtctgcagagtcctgaggcagcatggggcatcgcatggtgaacgggctaagtgtgctagctcaggtctttcttcttcttcttatgaagccatcagttccattcccacaataacccattaatccattaatccatgggtaaattaattgattaatgaagacagggccctcaagacccaatcacctcttaaaggccccacctctcaatactgccacattgggaattaagtttcaacatgagttttggaggagacaaacatttaaaccatagcaactctatatttttcttccagcttccatccccatttgttcatcctcccttacaaatacctctaattcacattctctcacttcttgaacccacttggccaggttttcacccaagcactccaaagcttctcttaccaagtcgccaatgacctcttcattgctaaccccaatgttcaattctctgacctcatcctacttggtcaccagtttcttttctttgatatagtagcctccccttatcagaggaggatatgtcccaagacccccactggatacatgaaacctcaaatggtactgaaccctctctatattttgtttcttaaatttgataactgagatggctactaagtgactaatgggtgggtagcatctacagcgtggataccctagacaatgggattattcacattctgggtgggacagagagcgacagcacaaaatttcatcatgccacttggaatggcagcactcaacttaaactcatgaattgtttatttcaggaattttccatttaacattttcagactgtggttgactgtggttgaccgtgggtaattgaaactgtggaaaaggagggactactgtgctttcttcatctggcttcccattctccagtcttcttccttcctcagtagctgcacctcccaggctcccttgctggtttctccttgttttcctcatgcttcaatgctatgaatcccaggacttaggcctttgagttcttccctgctacattcattcctgggtgattttattccatcccatggctttacacattatctacactctcgtgtctgaacttgtatttctagtctgaattccagactcatacccaacttcctactcagcatctccatttcaatgttcaagttaaccatcttaaacccaaaattgaactcctctcttttctacttgaaacccactcctcctgaagtcttccccttttccattaagtgcaattccattcttctagttacacaggacaaaaaatctcagtgtcaccctcgatttctctctttttatccttccctcaccaaacccatcagcaaatgtcgttagctctaccttcaagatacgtccagcatttgatcacttctcactgcctctgctgccaccacctgggccaggccaccactgttacccacctgattcatggcaccagtgcctgaacatgtgggtcactctgctcacacacttgaccctacagcctgtctcaacacttccactgtctctaacatgagtcacagtgaacatgagtcagactttgtcagtatttctttgggtattatcaacattaattactatattactttcatgcctgcagacaccatgaggtaaagtgttgtgttttgaccctacacttactgaccccagacaaatatatttttctatgttcttatggttcttccgatgcttactgccactgactgtgttaccaatgtaatcagcagggctgcatcctacgctgtgcatttgtgcactacccagagatgcatggctgagtggggatcagagcccatgttccacactccaagccatgagtcctggtggacactgcatctgtccacccagaaaagatggcacctttctttttgcacaaaatgccttttgcttaacacgtcctacacctacaggtctgtctacacttgtgtctgtggggggttgcctgttctatttggtctgctcagtgcagggagccttttaaaatctgcttaaaggcactaaataggtcagtagcaggcactgtgcacactgtgcacttactttagttactttaggtaacttacttacctaaataaagcaagttaggtttccaggctcataaagaaattagaagaagcaaatgcagtctatattgtcccatgtagactgcattcgctgcttctaatttctttatgagccaggaaacctaacttgcctgatttctgtatatgaccaaagtaagcagactttaatgcagagtctcaagaagttgctgtatgactaagtgcctggaatttagagcattgatcttctggcatctatttggccgttcaaaagttctcttggttttggatctcggttctgttctggacatctaagtaagatacttctggattaacggaagtttatgggattaaaatcatacccaaatatagtttgccagaaagtgctttattaatctctcaagattaatactatatgcattttttttcaggatagtcacattagagcaatcctttctataaagactatttgaactttacactaaaaatgtgcttgaaatcattttaatctacttgtcacagtctcttcatgtctgcagttttgttctagcatgggctcagatagtgatccattcctattaccttactaactatcatactatcctacaagacaagagaaaggtcatctgctcccacttcctgatggagaaaattggaaacagataaatgcataggtaacttgtaaaatattggagcatgtagtgagacagtagcacataaaatattttgagataggtttatagaaactaaaacttaacattgaccattcagtgagtcagtaagatcctcagaaagatatttatttcccaggactgatgaggttaaagatagagaagagcaactcatagcacattacaaatacttaatatttttttaagatggtaaaaaacagctctttaaatttctgtaacccaactcttagacttcaataatttcattaagaggccccttactaatattttttaaacaagctattcaactccagaagattcatcctgtgatccacatttgcaagaaactggactgagatggtggtacggtattctaagcaatgttttattaaaaataaataaccaaaagcaagtattggggctgccgagagaaggaagcatcattcggtagtggcatgtggcagagatgccaatccaaggtgattatgcaatgagcataactgccaataacacttacttggggcttgtctcccagggaaacggagatagagttggattaatttttagcccagtttatgattctgcaccagggaggcatgtggtgttatttcccagggcatttaaattcttcctcctaaagcacaacactatcttgtcctgttctatttattttcctcaagtgtgtgtgacttgcagagcattaacacgccaaaacatatgtttcctaagcctgttctcccatctcaccttcacttagactttcaaggtcagagctatttgtggctatccacttaattggacttaaaataaaaggcagcagaaaatagtagatttgtaatggcccttcatagtaagcatcaaaagagcagcctggctgctcatctgaatgctatttaaataaatctgcctcttattataagtcagggccacaaaactccatccaccatgccaccagttactgtgtagctgacacaagctagaaacgagagcgaggatgtttcctgagccccctggaaaccactggagctttgaaccaattgtgcatttttgtataaagcatgatcatgtggttaagttctctttgccctcggaatgtgcacattaatcagctttgtgcaattactgtccatgctagacaaggacagagtagatcattactgctattgttattttttaccgtatatatggagcttcatacaattacaaagtgctgttcaagatggatgcaaatgttcctagggcatggaatgggaggagttacatatattgggggatagaaggtggatgggcaagtttggtccataaccaagatgtataaagctaagggcccagtacagacagcaaaacaggcaaagttcacatcttggagcaaaggcctgtggcctaactgctttgctggtagggcttctgggcaagaagtagggaagattttatgacgagaaagtcttttagataaggcagagaagaatcaggagcaggcaaagaaggatgatgcagcaaccagatgacaggcatcctgggtccaatgttcaagtagctttgcattcccaggttctctataatcaggaagtcctgggccccaaacaacccctgaatcctcctccaattcttagcttcaggggaacaatcttttccaaggacgagctcaaaggaagaaacagctttagggttgatccaagggtctcaaatcactctagataaaaatgtgcttagaaaacaagatagaacagcttggtaggggttcccaggctaggagctgctgtatctatggagcacatttcttaaaagctcacagaatggaggaaaatatttgcaaaccatatatctgataaggggcttgtaaccagaatagataaggaactctgaaactcaataataaggcaaatagcccaatttaaaaatggacaaaggacttgagtagacacttctccaaagaagctatacaaatggccaataagtccaacgttatcattaatcaggaaaatgcaaaccaaaatcatgaggtatcactttataatcacaaagatgggtataataaaaaagctaataacaaatgtcggcaaagatgtggagaaatcggaactctcatacacacaggaaagcaaaatggtccaggggctttggaaaacagttggcagttcctcaaaatattaaacatagagaacacatgacccagcaattctactcataagcatatgccaaagagaactaaaaacatgtattcacacaaacacttgtaagtaaatttcacttcagcattattcctaatacccaaaatgtgaaaacaatctaaattcattcaccaactgatgaaatgtggtgtacctatatagtgcaatattatttggacataaaaaggttacaacatggacgaaccttaaaaacattacgctaaatgaaagcagccagtgcaaaaagccacatattatataaattcatttatgtgaaatgtccacaataggcaaatctatactgacaaagtagattagtggctactgggggctgggcagagggaggaattgggagagactatcagtgtgtacagggtttctttttggtgattaaaatgttctaaaattagatagtgatgatggttgtgtgactctgaatgtatatgctaaaaaacactgaattatacaactagggtgaattctatggtaaatgaattacatctcagaaaagctgttattaaaaagtcaatagagaaacattatataaggctagaaggcaaagagaactattttgggccacagctggaataaactggcttttagaattgaaatgccttacctaccctgatgcccacacttgcaacctgaggggacaggagggtttctaatgattcctctttcataagtaggaaattagtcatttgctgcttgagtttaatacataaaacactacattttatgactgattcaggctcagactttttatcatgaacactcatcatcaccactatcaacttcttgaagcattaagcgccctttggccttctacctatgacaccaagctaggcaccagatactgcaaatgggaccagttagttactaagtcaaggggagtgattcaatccaagacagaaaacacagatgctggcaaaccaacatcagtcacaggtatgactagataggtgcatgaatagctaagattaaatattgatgatacacacaagagtgaacacatttatagggtggcaagaagagggctcaagagaatttcatggttgagcaaggtttagtttcagagatagggaactatttctctcttaatcctctgcaagaataaaaggaaagcaaggtcaagtccaaacactgaggatttgactgttagttagggattggttggggaactgcagattcatatggctgcaagggagacatcaagagagaggtctaggaaatgaaacctaggaagtaggcaaggccctgaaatggcaataggaaaacactctgcagggaaagataggactgaagaagagtaggcttgtagcacagagaagggactcagagcaaaagagaccaggagaagtgtatctttggtgggttggggaggaggagggcagaaactggattctgctaaacacttttcctgtttaatctcatcaaaaattcataccctccctatgaggaaaatgctattactttaaaaatttatggataagtaaacacaagcccagagaggttaagtaatgtatccaagatcacacagctaggaaggtctatccaaaataatctctgtcctaggcctaaataataatttcattgtgttaacctttagccatcatcggccgtctcggaaaactaacaggttcctggaatacaccaatattcaatgtctattacgggcctgaaataagtggttcaatatatatttggttgctatcaggtggtacggaaaaagaaaaccacctcagcctatgtaagttgctagaacaacagatgacagtttataagtgggaaaaacggtgcttcaggttttagctgaaggtgaaacctgtatttctacctacaccctgcttgtctaactcagtgtccatcaagcagtaaaagagaaagttacttacagagaagcagaaactcatctggccctttccaagaaggtcctgtagatgggtaaagaagccctcattactcctccaaaggaagcgatcctctttaattgggtttcttaattggaaaggcactctgaaggaaataagttcagcgattcatgacctaactatctcttctgttggccaacccataagtacaagcaagtatacttgtttctttcccattaacagagaaacacagagttatcagagctggcagtatcttggagataaactagtcctttcattttcaaagagaagacgcttggggcaaagtgcctggcccagggttacgcagccagtgtctgggatgaaagggacttctttccaggcttagtcctgctgatgcaaaattgtgactgcaccctttaaaactgtgaacactacattaaatatggcctggcgcccagatcctttccaaacccaccagtttttacccatacaagaaccatgtctgcatcatttggtttacaaatccaatccttcataaaaaggaaacccacctaatctaaatgcagcttcttgtctagattctgcttttctctgatttcataacctctctgcttcacccacatttcttttccacctgatgacaagctcactgggaaccaagaatgactggaggctcagcaagcatatcatgctgtgatctatgccttttttactctgcaatcgttctatctcagagccagagagcaatacatggtttggtgagtgttggcctcaggattctacagaaatctgcattggtcagagttagccaaatggacatagatggtgtgtgtgcttggagaggaagcattgatgatgtgtggatctaggtctaaatggctgaaagagtcccagtcatgaagattagcatggatttatatgtatttaatggtccttttagatcatggctctgaaatgctaaataaattaattactaaaaggaaaagctgagggtaagaagcaaggccaccaccaggccaaaagacacctttgcggaattaagaaaaggcaccccttcctctaggcagccacagtcccacatcagtgcattccgctcattcagtagagtgatgtctagcttccttctcctattcttcaccttgatcaaacagatgcccttgtagagtacacaactagtacagctttgcagggcagccctgctgaaagaaaggaagaaggagaaaaaaacgttcttaacataactaaggccacagccctttggtggtccatgaaattattttagaaagttgacaccagtatttttaatagaatgaaaaatttacaaaatataaaagtgccttatgcttagattttatctttatatggatatgtaaatatgcacatatgtatgtgtgcatgcatgtgcacatacatattgggttgagagtaaaatatatttacatggggcatggtcaaaaacatttgaaagtcactgatttgacagctcacaatgtgaaaagtgaatctaatttggaggcctgcttcatctgtatttttaagtgcccagtgagaagcactcaggtacaagagaactagcttgcagtttgaaatcagacaggctcaagttcaaacgccatttaaatatcactaaatttgaaccttaggcaatcatttatgtttcccaatcctcagattcctgatctgcagatggaggtgataatatttatttcagagtgttgatgtagtaagtacctggtattaagcactgcctacttttcaaatccctctcttctcttgactttggagagacctatagagaccagcagtccagggacacacatgcagctgcccaggatagttttccttgtcagaagccacaaatgctgaggcggtctagcgtcctacagtaaactttatatgactttttcccatgcacgttgttcttccatctgtctggaagagctacctcccacagcatgcttaagctaaaattattgcttggtcaagtcaattaaatcatttgagaaaaactactacatgtaagtcagttaagaaaaagagttgggtgatatgggcatggctagactctggtcttctgtttagggtgaatgtattagattgctgctttggcctggttagaatattccacgttgtaaatattacagctcctaaggatagaaatgaccagctaaaaatctgttaggtcactgagggtgaatctcccacattccagatgtggcaatagggttccttggaggtacagaatcccccttaggttaaatggccaaggagcacatcccagtccctgaaaacttcatttcccaaatcttcggtcatgaggactcctcttcagaataattctcccattaaaacaaaaacaaaaacaaaacctgcaaaaactgcctggctccatttaggtgtggaaatggggagagagaggagagctaaagttagtgattctcagcatatatttgtaagagatctttgtgtgagtcatcacagctagctttaaaattgacacaaaggacacaggaaactggcaatctataaaagaaaaatgtcattcttcataaacatatgtttcaaagcccagactcccaaataaagcaatgcacatttaaaacaattaattaaaatgctacgtttcatctatgaaattggaaaacattaaaaattataatattcaacactactaagtatgtagcaatgtggcagaaactttaaaaagctgataagccttgacccagaaattctgcttctacgaaatcagaaattcatgtgtaaagctatttgttgtagtattttttataatgttaaatattgcaataaatggcaacatgaaaatggctttctatattatgataatactaaacagtaaatagcattttagaaaaacatttaatgatggggaaaaggctccataataggccaaaaatttgtaaaaaccttaaaattgtatatattcaatatggtaaatataaaattttgtatgtccaatatgttcctatttatttaaatacataggtgtgtatatatatgtctatgtacatatgcatgtgtatatgtatgtgtatatgagaagttcagaagaatgctatatgcgaaaatgtgcatagtcatctttggatggtgcaatgagagaatataaactgttcaaaattttcttttttatattttgatgtgtttttaatactcttgtacaatgaatacataattttggtatctgataaatatattatttaaaaggcaaacctaaaatttaaagtggcctcatataacttcatgttagaattgctcctcagatttgaatgactaaaacttgctgtttctaggatttattattttgatgagaaactttactatgatggtcaggctgtattaaacattgagagaatgccattaaaattccataacagtgtcacttgttgtatgcattatcttttgagaaatctatagtctgaaatttctggcaatagaataacaaacccttcttaatatattactccctaaaatgttggaatattacacttgaaatatatttttcaaatatctaactattttatttagtgaggaataagggattcttagaacccagaacactgaccaaatacaagtccagaaatgtctgtattgctttgccttcaaggtatttgccattccttagcagcctaaagactaggtttttagaaatacaaacatgaggcctgatagcgggaagggagttcagagaacttctctatctgtaagctgagactcctgaagggttgacactttcagtaagcaaataagaaaaaaaaaatctgcctcgcaaagggagatggtaggatgtgtctatttgagtcttggtttttagtgctgctgaaagttgaagatggggaagaaagatgaatctcccttaagaatttttaagcacaggctcgctcatacgggtttgcagtctgaatttacactacctgggtagtaaaaaagtcaaacatgtagcttagaatggccccagttggtagtactcccggacctttgacaggagagcaatcctctctggaggaatgtacttaaaacccaggcctcaatggagttccacaggtaaagtcccaagaaacatatgctcaaagtttaaaaaaatttcatggttaagaatcaataaaacaacaaaactagacccacaaagatattgccacaaaatttatcaacaatgaaatacaaaataaatatacttaacatgtttagaggaataaaagaggcattaaaagtatgatgaaattagaaacaatgaaaagctacctaacagatttgaaaaagagccacataagacttgtagaaatgaataatataactaaaattagaaagtcaatagatgcgctttagagcagattagacaaaattaaagagaaaatgagacgctagaaggtagatataaagaaatgacaagaatgaggatcacagatagaaaaccatgaacagtgaaaacacgtggaaggtaagatagtacaagatacgtctaactggaattctagaaggcagactataggaagattggggtagaggcaaaattgttgggaggcactaatcctcaaaatcaggaagcctaatgagtcacaaatagaggatacctaaatgagaaaatcacacctgacatatcttaaggaaaatgccaaacactcaaagcaaaaaccttaaaagtagtaaaggaaaaaagataaatttcttataaaggagcaatgtttacatggatggtagtctttcaacagcaaaaacggaattgagagacagtggaatattattatcgaaattggacgagaaaataattttctactcactacttttgtcctatatttcaagaacaaaagtgaaataaaactctaagtaaataaaaatcaggtgcatctactattaacagattaagaaacatcatgaatgtacatcaggaatagagggaaaaaactgtagataaaaggtttggtatacaagaaggaatgaggaggggaaaaaccagtacatatgtggataaatctaaaaatattgatggtaaaatgacaatgtctaatttatgaggcttaaaaaatgaaagttataactcaataaagctgtttacaaaacatcaaggtaggcgggcgcggtggctcacgcctgtaatccgagcattttgggaggccgaggtgggaggatcatgaggtcaggagatggagaccaccctggctaacatggtgaaaccccgtctctagtaaaaaaagtacagaaaaattagctggatgtcgtggcgggcgcctgtagtgccgctacttgggaggctgaggcaggagaatggcgtgaacccgggaggtggagcttgcaagtgagccgagatcgcaccactgcactccagccagggcgacagagcgagactccgtctcaaaacaaaaatcaaaaaccaaaaacaaacaaacggacaaaaaacacatcaaggtagagcttaaattctagacttcgaattatatacaatgggtgaagtggtgactgagtaattttctaaggtacttaggttgtttagctggagcgtaaacatcttaattaactttatagtatgttaagttaaatacacaggttaaaattgctttttctttttcttttttttttgagatggagtctcactctgtcgcccaggctgcagtgcagtggcacgatcttggctcactgcaatctctgaagcccgggttcaagcaattcttctgcctcagcctcctgagtagctgggattacaggcgcctgccactgcgcccagctaatttttgtatctttagtagagacggggtttcaccatcttggccaggctggttttgaactcctgaccttgtgatgcacctgcctcggcctcccaaagtgctgggattacaggtgtgagccaccgcgcccggccacacaggttaaaatttctaaggcaagcatcaagataatagaaatagagtgtaggctcacgcctgtaatcccagcactttgggagctgaggcaggtggatcacgaggtcaggagattgacaccacggtgaaaccccgtctcttctaaaaatacaaaaaattagccgggcgcggtggcaggcacctgtagtctcagctactcaggaggctgaggcaggagaatggcgtgaacccgggaggcggagcctgcagcgagccgagatcgcgccaccgctctccagcctgggcgacaaagcgagactccgtctcaaaaaaaaaaaaaaaaaaaaagagtgtatacattccaaactattaaagggaaaaagagagttagaaaaaaaattcaaaaaaaggcaagaaaaaattctaaaaagaaacagaaaggccaaaataaatagaaagtatacaataacatgatgaaaaagaatccaaatgttacagtaatcatagtaaatataaacaaagtaaactttccggttaaaagacaatgcttgtgaaactgaattaaataaactgcatgcatattctggttactagagacttacctaaaacaaaagaaggttgaaaataaaaggatggaaaaactaaacttgccaaaaccacactctggatgtacttgtgtccccagtagcaagagaatagcttaacacacgatcccattctttgctaaagttaagatacaaattatctagttctaacaaaaaagaggggaaggggacaaaaggagggaagaggagaggaaaagaaggacaaagagaggaatagatgaagtaggggaaggtggaagggagagataatggtgactccagttctctaggattcacaaagtttaggtcatctgttgccaggggaaaccagaatagcaagggaaatggccaagggcaatttgaactgtgtgtatcaaaatccactgggcccttctgggtctctcaaaatgcctagttcactctctgaatcacaagcagtaactgacgggtttacttttaggataagtagagggaaacaaaataaggaaaatatcaccatgctgtatccctagataaacacactactttcacagtcagttaagaattttaatgcctaagtttttttcttttaagaaatacagagaattagtttccaaatctatcaagtaatacatctttttatttaatataaggaccatcttacctactttgaagtttgtatattaattttactaattaataaattctgtgtcttaagcaaagttgaggcaacacatgtatacttatacaattatttatggtttagtactttacaagaactacttcactttatgaagaatgtttataataattttgttttaatcctgattttccaaagaacattaatcacaatttgaattgctaaaaccctttacagcttttcagaaacacacaaactgaataaagcaaagcacacctaaattactaagtagtctggccctccaactatccagctttaagcatctttatttagattgtgcccttcattagaaccaggccaacttgctgtcagattacagtgccaagtctaagacgaagttaaataccatggacagctgctttctaggccaatgacagcctagcaccataacagatcaacggcccccagcagccaggctaggagcatagcaaaatgagccgaatgatctgaaacttaactgcttcacatcctgcaggattcaaacttattcctaaccagctatacagacattttaagaagagagccccaaacatctataaataaaaataccccaaaagcaaaagtctctgcttagaatggatattgctaagtcccagccaatgagctactcactttaagcaaaattccaaataataaaatctcaggatgaaataaagacattttgaagtttccttggagttaatgtttgacccatttatattcactgtatgtgaactagagcttatgaatattataatacagcaaatattatataaccctaaggggtatgacggactgcttaactcaaggattcactggagcaagttcagtcttcaaggaatgttttataactcttgaatctaaaataatttattccaactcatttttcacttaagaatgaaacataaaaggaaggcattaacattcattgaaaacaacccacattttccaaggatcatgctagatgcttaacattcatttcttcatttaataattttaccaatcttatgaagtaggtatcattattctcattttccaattaggaaactgaggcttagagagttaaaatgacttctctgaaatcactgggcttattacacaaccaggctaaagactctttcctttttgagttaaagccccagggtctcttcactgtgtcatgatggtatataactttttaaaaagggtagtagcatcactaaaagaaataacaataataaaaataagaaccacacacaaggtagagaaatttaaatgagatgagaaactgttgctttaactatgaaaaataatgccagttcatgtttttccatgcttcacagttaccctatgatgtacatcatcaacaatggaaccaaattaagattttatatttgcctatgaagcaagtagtttcaaggatattcactgcctagagcccagcagagttgacttttttgcaagaaccatttgatgatttgtataagaatatctaaaatgtgattcctctaccttcccaaactcccatgtcccataattttgcaaacaggacaatgaagtgactttgcatgaaaacatgcttagtattttgcttcctaaattcttgtacagcacattcctctctaggaagactccactgaaggccgcatttggcttaaagtctttttttcctagatgttttggtgatgtcagaagcattaatttctgtaagaaaggtaagctacacagtcagaattcaactctgcagccaggtgactagatgaccacactccaggattcatccccatttcaggatgaatcaaattacattaaaatcacattcagagatgtgattatgttcagtgcctgggggggaaaacctccctaagtttctgcaatcaggcatatgataaaggctgtaattacagaaaaaattccagcaataattcaaaagtgaaattggcaagtggtatttcctaaaggaaatcacacatccttatgcacgttccacttaaaaacgtgtgactgtgctctggcatttttttgagaagtacaaaataagacatagctttgtttagaaaaaaatctctacttccattagttaaccaatgtcaaaagaaacattaatgactaactggaataaattaaagctatttggtgctaaatggaaaacaatacaatgaacacattttggggggaaatcagaaacagaaatagttatgaatataacctgctttctttttcaatcaagtaaatctagaattcccaaattttagaacacacaatattaagtatagcacaaaattatggatgcaaataacaagggttaagggatgacaacctgaatttctgaccttaaaataatcataaaaatgacataagtcacctaattgagtaggtaaagatcattccagggctactttaatgaatggtttataattgactaaatacagtctataaacctatatttggaaagctatttctaaaacgcatgaaagcatcttccactccactaaaccatcttccaccccactaaaatcagaatacaaaatccttccgcaatcctacatataccattggattgctctgcagattcatttttcataaatgttgccaatataacattcagccaagtctctaagttaatgaagttccactagggtgtaagaaaacaagaaagtactgagttctcaaagagacttttcagcattgatgcacccaagaaatttataagacatcgaatcatttccttgcctctaaaaaataagcatttccttgacaatcgttcagtactttaattggaataaacacaagactatcaatgtacaccacccaaacggactcgaggagagcacttgagggatcacctttttggctgctaagttagagtaggggagaacttccaatgatggtcctattttatgccctgaaggagatgtactcagttgtcacatctgaatgcttgtttgccgtatattttgctaaatgattttttggttttactatagtttctaacaaacaagcatacgagagaaatgttagaaaatatgtagtacaagtagaaatattgctagtgttttatcctgccctttgcttccatttcatggctgcaatgaaaaggacggtcatcaaacttggctataaaagaattatgcaaatttaaccatattaatatcatttttcttttctttttgaacaaaatctttcaccccctgctcaaatatctgttttttgcatatatgagaattttcccagatgctggcatgaaaagtctatgtaggtattttggctttctgtttaaaatcacattcagagatgatattccactgctaggatataaatcagaactccattacaataccacatacgattgtattgatgccatttgtccactatttaaaaaaataatttaggtgtttgcaggaattacttctaagctctttaccaatctgctttccactcacctaagtggtaggatggccacgattgttattaaaactccctcaaattctactctaaaaatagttgaagtcatgtttattatggtgtgcaaagtgggtcattgtgatgcagaggcagatggcagggctggccaatgattctctttacaatggatgctgatcagttcctggtcaagtgacctaagacatgattgtgtcaatcaagaaaaacagccatgacaacaataatgacaagccctgctgggctaggctgctgactggaaggtacagctacggtgacacaaactttcttcctcagacatctctaaagagatggttctttcttggtaattgccatgtgttcatttaaaaagaaaaggccttgcaactttctaggcacatacacactttcctatgaaaattaaattgttcacaaaatcattatgcccactttcagaaaataagagacaaataactgctgaattggctttgggaggcttatgtaacctatatttacaagtgttttactctgaagcaagtagctgaggaacttagtaaacatctgcaagaataccccaaaattattttttccactgctatgttagtctagctatcacagaactgcagaatcaatctgctatccacaagagccccaaacaccatcacatcaaaagaactgcagatctcaaaaacataataattcagaaccgtagtcaagaaaagcattaaataaaaatccaccaccaccaacctttgcttgggcttctggtgctgtcaccttgacgaccttattgcggtttatcatttgcttcacccatttttctacttggacgttgaatttcatgaaaaccacatagcaaaaataagctgttaagagaagcaagctttcccaccacatgatgacattatccaggaaaaatatgatcagcatgatcaagtcaacaatgtagaaagacacatctcgaaagagcggccaccatgtcaggtttaagatttctctagaaaacagagcacacatgccaataacaaagaggatgttgaatactgctgaacctacaattgtgcctatgccaacgttgctgtgagcgataaatacccctatgagagatgtgaaaagttctggggctgaccctcctgcagccatgaaggtggctccagccacatcatcagagatgcccagtttttcagtgatgacagtcaaagaaggaacaaagaactcatcacagacaatggctaaggctatgaacatgtagatcattccaatgacatgcagaatgatcgcaccttttcttctctcctcaagggaaaagatgtctttcgggtagtctccttgggcgtgatctgtactattctcagactcgccttccttagaaagaggtggctgtggagtataatccagaatcttgtcatttaaatctaagagagttctctgatggtaaccctgtgctaccctagggccacttacaacactggcctctcctgtgctctgtgtatctgtctcagaaaaggcactgattgaaaatgagacagtgctaatggctaccagacccatgaaaaggcctaagactcgaattaacttcagttttttcttgacactataatgtcttctgcagccagacagtgactcatccaaacaccatttctctagggaagtgatggtggtgctttgttgcagatccatcctgggtcttctggtggatatggtgatcttccaactttagactcaaccagatggttctttcatacttttccttactttatagttaacgatgcttgtggggtactttcacaatcagggattgttatgcttcacaggaaactttcatcatttatgcttaaataaaaataaaaacgagaataagtaaatcataaaatcacgtctttttaataaagatctttgcagatatgataaagtcctgtcctgcagctgtgcgatcttgggtaagttacttaacttctctgtgcctcagtttcctcatttaaaatggggacaattacggtacctaccacccaggattgttttcaagatgagtaaaaacatatgtagcacttagtatgggatgtggcacttatgaagatgtatgtataaacccaaataaatattttggtaaatccaatgttaggtgcagagaaggcagatgtaagaataaaaattttacaggtgaaaatctatcagattatctcaccttaaatcatgtaataaccttccagtgctataaaggtacctagacttctttcagaactgtctaggtacttggcaactaacaattattcattgtttacttttggtccaattacataattctcagttgtaggcaactttttctgatttaacctatcatttggaaagtgagtgattctttaatttagtgatcttttttctgcacacataatgatatcagatcttatttttcataaaaagtctctcctttatcagatgcgggaaagtagtcctttacaaatttaagtttacaaaaaaaaattctggtgacatgcacaagctgccttccctaaacatctagacattgttttcagctaaatattttttttaaaaaaacaacctttagtcatatttaaaataggcagcttagtaagtcaaagaactcccaatgcagtgaaataacaagtaggctatttcgagagaccacatgtgtatttcataaacaatacgcaagttgtagcaatacctctgtccacaaaatctgcccaaaatagccccaccactgactttaataggttagatatccaaagcagagttttctttctctatcccacggaggagatgggtaaaatagccagacttgacagctgatattctgaagagttctctttttagtttttctttaaaaagactattcttttccatatcaacgatttcattttggaggcagtcgctgagataatctcaggtgtaaaataagctaattaaacacacgccacttaaatactgagattagctggagctcaggttttcagagcaaagcaagagcacaaatcaaccccgctgagttgctgctactcctgagataacccgaccccatcacggagattcccaggtggctgcgaacgtcaacgcttagcaggaacgattaagcgattcacagcactcaggggattgtgtaaatgcccggcccgggcgaccagcagggacagattcaactccccgggcgcaaagtcatctccagcccgatcctcgctccccctgaaaacccaccgctcgtctccccgggagctgcctccgtaggagaatgttcgcccccagccgcgccccaactttgccttgcgtggtcccaaactttccctggtggattaataggaaaataaatctaaaggacagacgccccacctgtgagcttggagctgggttgcatttggtgaggcgcttggcccgcatccccctgagtcgtttgtaggtggctggggaatggaagcgcccctctgcgcgtctcccccgacggcaggccctgccccacgccccccatcccaagccaaaagcaagggtaggagaggcgggggctccaaatccacgccccggagcacagagagttggctaactcctagcggggcctggggcgcccacatccacggcagagccacctgtgagcctgcagagcagcaacgggatgcgcgcaaccgggatgcggggacgaccgccacagcggctacagcggcaggcggggcgcagccgcccgcacttaccaggataagatgggaggacgcgcacacggcggggcccccgagcgcggcccgccgctccagtccgccggccctccgcctacccgctctgaggcccgggctctggctcgcactggctgccgctctcgccagccgggctgggttcgggaggagactgagccgctgtgagcccggcgctccgagtctggcgctgcccggcccccgccggcccctccctctgggctgtgcgctgtgcgctgggagcggggccgcagcgcgctcagctcccgagtcctttgctccacgcctcctgggcgcagaggcgacgctggcagccgtctcttaggagatttctccgcagtgtggacgggggtcaggatttgcaggcgagcaagggcagagaggagaaatcgtacaggtcggtgacgcgcctaattcacaaagcctgaaagtgctgtcaactttggggtcatcttatgctgggcaccgcctctccaattatctgcaaaaagtgatagcagtcgcgcttttctttaggaggcgatgtgatgtgtaatggtggaaaagacgttcaatgaaaaggcacggaggcctgcaggacaggctgttggggtccagggtttcttgagtgttggatttggatgcttgggacactgcaggggcttcagtcttgcagggtgacctttcatttcatgggtgatgaaagtgagacccaaaaccccgtgtcattttgaatcactgacaggcttcggcttttggcctcgggatgtccagcccagtgctccttcctgtcctatctggaaagcaagatccccttgaccacaagaaatagaatcaggcttgttggggatgagagactagaatctgggccaaagaatggaagacggtggtaagacaaattggtagtgagggaaccccttttacccaaccctgtgaccaccagcaaagctgccaagaggtacccaactcgtgaagctctgaaagcttttcgcacattttcccctctccttaccctccatccttctgttctctcccccatccaagagggtttcttcatgccctccttacaatgggggtaatgggtatatcctgagagctcatgacctctgacttagagtacagctctgtagtcagacctctgggcctactcatcaataagtaaagggaagcctagggaacttagaaatatttttcttccccccaccccccaatcaaagccaggcattcaagactcaacttttctttttctttctcctttcgagactgaatcttgctatgttgcccaagcttgtcttgaattcctgggctctagccatcctccagcctcagactcccaagtgcttgcagactataggtgcctgactgaatttttttatctttaacttttaatttagaaaatttcaaacatatacaaatgtaagaaagtagtataatgaatctccatggggccataaccagcttgaacaattatgaactcatggacagtcatatttcatctatacccctttttcctatgtcatcattttgaagcaaatcccagagcatcatatcattttatctgtaaatattttcagaaagcaagaaaactatcaactaccactagggttgtgtcaagaaggggacaattcaaataggctgtcactgaccaaagacgggctaatttgagcatcaaaaaaaaaaaaaaaaaagataatcgcaattgtttaaaacacatcaaacatgattatatctattaattgataatattttaaaaacaactgaacagattgattgcttgatggttcagagggaaccagctcataattttcaaaactgttttaggaaaaggaaaacaattgtgcatttattttgccttttctatacaaattggacctctgggtaaccaattaggctttatttttaccctgcctttgtctactttcctagtttaacaatcctattcttccctgaggcaataggtgcctctggctacatggggtgcggaggggaatatcacaatgtctagaagagtttttcttatgttatcttctagaatttttatggtttcaggtttttcccctacagctcagagatgaccctgagtcttgattcggtgagaagaggaatgagatccagatgaagacctcatgagtccatagattgtattggctgggatttgcacttggttgcacataataaaaattcattcttggtgattaaaccaaacaagaatttatttttctcatggtaaaaagaagtctgaaagcagactgcccagggtttataaaatagcttcaagatgctatctgggaacccagatcttttgatctgtctttcttaatgtatggctttatcctcatggctacaaaatggtttattcttttgcattacatctgtgttccaggcaggaagaagggaaagagtgaagggtgaaaggcagaaggcctccttgctaggctttgtctttttatttaggaagggattctgtcaatgcttcacttacatttcactgatcacgacttggtcacaagacatagctgcaagggagtgtaaacagtatttcaactgagcacatagtcatcttttagaaaatcagggctctcttagtaagggagaagggggagataaatgttgtgggagtgactactcctacacagttccaaagcatctcaatgagatccatattcgactcaagatttgacagttgaccaagaacttggcaattaattgccacaacagttgagaaggctacaacttccatcctggtagtaatggagaaaagcagggcctgtcatttgtccaaatcacactacgtggaagcagaggaattgaataacaactgtaggtctcccagatccacagaccttattgcctagtcataaagaaagggtagcttcaggagaaaatttactaccatcaaatgagttattaaacagtagcatttgctaagagactcaagtagattaatcaatgggtctctttttagaaattattaaggagctacttctttatatttgtagatacttgtgtaagtataaacattagttggcctcatatttacccttctattagctgtaagattggttttaacatatagtttataggagtaattggtattaccagttaagaacaatgggctctttttgttttgaagaggaggctttcaaaaatcagtaatgaattttaaaaatcactaggtcatacctaagctaataaaggatttttaatgtaaaactgccaaaggggtgctagttaatagttttgctaagcacccatataattttcacatagttatctaggctggcatgatttaaaataggttaggaatatccccttgccccatctgaaataacatccccagggggccacagtgtctacaattccaccattagaaattcattgctttggctttatattttataatttcaggaatttttaaagaagcaagtagctctggagtcatagtaatgattagcaattttttattgtttttgacttgacattcagtctcaagggaaaaaaattctagtaaactgtcatgagcagaaggtgaaagagatggttgagggccaggtgtgggtgtggtggctcacgcctttaatcccagcactttaggaggctgaggtggatcacctgaggtcaggagtttgagaccaacctggccaacatggtgaaaccctgtctctactaaaaatacaaaaaaaaaaaaaaaaaaaaaaaatgctgggtgtggtggcaggtgcctgtaatcccagctacttgggaggttgaggtaggagaatcacttgaacctgggatgcggagggtgcagtgagccgagacggcgccattgtactccagcctgggaaacaagaacaaaactccatctcaaaaaaaaaagataggatagctgagtcagaaagttgtgggcaacccagggacaaaataaagtacagtactcatacttactttgttaatcatttctttcttcattctctccacatatacaaccttttttctgacttattaaaatctctagcttctctgttattaaaattgcaggcagtcagcacacttatgaagtattcaatgtgcacaaaaccagtagttccaaacctcgactttagctaaacaaaagaactggggttatttttaaaagactcctgacaatgaccctcactctcctcccattactgtgagccccgtgagaacaaagagtcagtatcatgcatttctcagcatctagccctgcgcttggcattttggctaacacatatctgtggagtgaattaagatgatggcaaatacagttacttaaaggaaggtgagtcaatcaggaggatgtaggttatgttatgataacaaaaagttcaaaaatcacagtggcttaaaacaatgaaggtttttgtttctcacttgtgctacctgtcctttgtgaagtttgctgtgtcatcctaactcctaaccccaagctggtcactatctagaacactgccatttgctgttgcagggagaaaagatgcatggcaaacctagaacttgcttttaaagcttcagcttggaagtggtgcatcactgctgctagtatctcatggactgaagcaaatcagatggtcatatctattttcaagggagcaagaaagtgcagttgcattgtgtgcttcagagaagaatggaaagatttggtgatgatcaataataactaccacaatgggcatcagtggtggaaaaagggaactgatatgttacacacctaccatgaactagagtgtttgctaatctcttttcaatctcatcagttttatcactattattatccacagatgaagaaactgaggctcaatgaggttaagtagcttgcccaataacaaacagctccatttgaatccaataatgtctccaaagcccgagttctactattcctcatagtatatgatagtccctgcctaactaagaattagttgcatttttcctgttgagattatatacttagaacctatagatttcttctaccaacagcccgtcaacaatcaaggatagttgtctacttcctaagaggatctgctttgcttatttaaaaaaatcacagatataaatatcaaaatatcctgatgttctttaagaaatgttctcctcaggcctctcagcctggactgattttgtttgcctttgcatttggctcattttttgtctggtggctttccttttcagtgcaatgagaaccataaaagcagaaaaaaatttctgtgggattgagggatgaaagtgcaggcttctttgcttttgacggagatttctgcaacagcacttaaggccaacccctacatgattgctctttcttcttttcttattcacttacgaggtaagaagtgatgaatgcctattatttttacattaggaacgggaatttttctggccttaaatgcccaggaagccctgaaattaagcttctctttgcaataccagctcagcttcattgcacctgagcaccaagacaggttatagttattatcctaagtgaattaatgcaggaacagaaaaccaataccacatgttctcacttataagtgggaactaaacatcaggtacacatggacacaaagaagggaacaataaacatggaggcctacttgagggggaagtgtgggagaagggtgaggattgctgattacctgggtgacaaaattatctgtacatcaaacccctgtgacatgcaattaccagtgtaacaaacctgcctgtttacctctggaacctacaaataaaagttggaaagttaaaaaaaaaaaaagccacagtgtgagttctccaagggcagaagtggggtctgtccatttcatcaagagacttggagtctcaacccttggctactattcctaccgatgccagcagggacttcctgagagtcccccagggtgcttccttgtctctcagaggcacaccagtaaggaaataaggataaataatactggtaaaggaggcatgctggagaagagggtacaaaggcaggacagcccactcggaaagcaagcaaggagcattgctctttatgactcaaaaaaaaaaaaataaaaaatcgtgctcctgctgccttctttcctaagctagactctacctatttctagttcagaatttcaacataaaataaagcttaaaatactggaaaagaggagccatgtgccttgagcctcaaacataggacaagccagaaggaaggtgctgctgtgtctatggtttctgaatactgaactaaaatacttgttttattcaattcataaaattgaaaggaatgtcactattttcccagctcggttgtggagaggggtctcaagttgttcagctggaacaaagcttcctccatctcctccatacagtatgtacatatgtggtgggcgtagtgggctggggagtatccctcagcatcctgacactgtgtgagcaggcaccccccaccacccccacccccggcccaatgccaggattcaggtaataagcctgtttggggttcatgcccaccattctccaaattggcctttcttagtaacaacagtgacagttcctctccacttgcctctctttttgctcatctctcaatttgtttgaagccaagataggaagacacgtgacatatattgaacccctcaaatactccacatttatattgaaaaactgtaaatctttctccctgaaacttctgctttctggtctctagaaagaaccatattcaaaggttttagctgttttgttttttaaagtttttttttccaggtacttaggaccatctttcaaagtaatgaggtcactttcctgtctcttgatttttctgattttgatgttacctactaaattcttatcagggaagaggtggatttcttcctctcacaatattctcccccctccctctctgaagcctccatctcaccatattccctcttccattcttcccatatagttatattaccacttggaatacattaatagccaccatttacatcctataattatgtaactatgcggcactattcacaatagcaaagacttggaaccaacccaaatgtccaacaatgatagactggattaagcaaatgtggcacatatacaccatggaataatatacagccataaaaaaatgatgagttcatgtcctttgtagggacatggatgaagctggaaaccatcattctcagcaaactatcgtaaggacaaaaaaccaaacactgcatgttgtcactcataggtgggaattgaaccatgagaacacatggacacaggaaggggaacatcacacaccggggcctgttgtggggtggggggaggggggagggatagcattaggagatatacctaatgttaaatgacgagttaatgggtgcagcacaccaacatggcacatgtatacatatgtaactaacctgcacgttgtgcacatgtaccctagaacttaaagtataaaaaaaaaaaatcagttgagctgcatagtatactaattcaccccaaactctctgatataactgttcatttcccctcactgttttcaaacatgtcagttgaacttcctgtttcttgtttcttccttgacagcccatgcccaagttttacatctcccacatggtactcattctaggaattttctgtttctcttctttgtgttaaaaaccctgtgtcctgaagcctctttcttgtttactcctttgctttttggagcacagcctccagtatcttccccagaatggggcacaggaggaaaatgtttgaatccttgtgtgtttttgatgtctttatcccactcccatactctattttcaaagtatggctttgtgaaaatctaggttagaaatcatcttccttccatatttttaaggcaatcctttcttcactgtatttgacatttcattatttctgtagagaagcctgatgtcatttgaattcctggtcctttttgatggaatctattttttcttttgagaagatctttaagtctttttacttgcagtgttctatatcttgatgataatgtaccttggagtggatcttttctcattcattattctctgcctagaaactcataaatatctgggaaatttgttttgtgtatatttaaaaaatttttcttctctccatttctctttcctttttggaatctctattattttgatatttaccttccttgcctagtcctctaattaaggctttatcttttctccattttctattcatcaactttgtcatttaacccttctcttggtaaaaagtcctcacatttttaacttttgagaagttctatcttattctttgcatatttctattacagtttcccatttttatttcataggtctagtagcttctcttatgtctctgagataatgtaagtttcatgaggtataaactttatttggtttgttcattactttatgttgaatgcctagaacaatgagtgcctactgtagtaggtgttcgataagtatctttgaattaatgagactatttactgtagcttattgtgtattttcttctgctccctgaagtttctgtttcccacaagttcctttttactatatttgttctggcctggttttcatatcacaggcctttctaaaatatctggtgatctttggtgtctgttaataattacgaatcaggcattaaaatgctaatgaaagctcttgcttggatgcgacctgccaagtagaggtctttactgtagagtaatcaagtgaggatgcaaccatttcacttccagaaacacatgtcagtatctctgcataatttctcttaggctgatcaatttccccagggcaggttctctaagctcttctctgaagtatttgtgtttggctgccagcagtatgagagctgagctaaaaaagaggctaggggactttattattcactttatagattttaaggtagcttacccttatcttcagctttgcctgatgtcctagaacaactctggcttagcttctacagagaatcaacctccccctttttgccagcgtgggaaggggcagtctcctggccataaaggatggggaacggtgtttgcagatataactgcacctttaagattttcagtcaagcttcttattttcagccccttcttgtgcctctgctctattggttttctattgtaggctgtaacaaattaccacaacctttgtgtttccaaataacatacatttattatcttacagttctttaggtcagaggtcttgtatgggcgagttctttcctggagactgtatcatgtttatatagaattggatcttattttttaatctgagattaaatttcacttaataaactagtttattcattttagttgcttgaagtatgttttatctaaaatttgtcatctcatatgatatttatgtttttaatgcttcatcattttctttcatttgttcttttatataataaattacacttgtatttgctgatttgtcaatgttagtagtattgatttgttgctaaaaacaaggccatttatgaacttaacattctttcttaaaattcctttcccaactttatagaacaaaataattcctacagccatagttagccttagtcctttactgaataagttgcataatccatctgcttcttccaaaataagattttcttacttgtacaatttttatattaattcataccttggttagctggatttaattaccaagtcatttttacaaagagggcctatgagtgagatctttaatgttgataaatctttccattgcttttatatatgaacaatacgtttgatcaaatcctttataccacacacacacacacacacacacacacacccctggaaattgcagatactgttccactgactctgtcacctggtttgctaatgtagagaaacacatatccataattttttcacttgctttatctgctcatatgtatgaagtattcttcttatctttgaagttctgtaacacaaatggcaagtctcagtgaagatctatagctatagctatttatacctctctctactttttctcaaataaggtatgccctttctctttgaaactttactttatttctggttaaaaaatgtgacttttttctgtttctagttgtatcatcttcttcgggaataattacaattatgcacatatcccctttccatcctctgtagaatctcctccctcattttcatcttcttgttgtatttcatttcattttatttcatgggattttcaaagaaagcttctacactattctactaactctttttaaaaataggttttattctacttcttgctgttgctaatggtagttttatttctactgtttctatttgttttcttatattcaatttcttttttcagctcttctaactcatgcttttttcccctactatctcatttctccagttttatctttcattcattctcttagctttttttattttatctacttagaaaaagcccttgtcacttttatttctgagagaaaatactttgctgaagtatttgcctgatacactttttctgtttcctaaagtaattcttcttctgtatattatttatctgccttctgcatgtgatgtttctttcaacgcctgccacgttctgtgtttatctatttggtagaatccatattgtgtcctttactcactcatcttttactgtggtaagttctctacatgcctgcacttagctcatgaagtttggagaggaatgggaggtaaggaatgaggtggagtcatctgaaatacctgtcagcttaaaatcagcttaaaaccacagataacataaaatctatagatcctctgcatgagccagatcttgccttaacttttagcctcctctaactgcagtgagaaagcacatctagatgagctcacagcatggctcgtaatgaagtctaatagattgcagatgttttgtgtttaataatttggtgtttatttctattcagtccactttggtcaccactataaatatgcttaatacgctcccctctctccatcatactctgtttttttaattggcatattcatttctttgggctgcctcaacaaatgaccacaaacttggtggcactgaacaacagaaatttattccctcacagttctggaggctaggaatctgaaatcaagcatggttaaggctccaggggagaatccttcattgtctctttctagcttcggcggctctgagaaattcttggcattcctggatttgtggctgcatcattgcagtctctgccatcttcttcatatggctttcttttctgtgtatctctctctattctcttcttataaagacaccagtcattggatttagagcccactctaaatctaggatgatttctaaatttggagtagatcatgttctgaggtttcaggtgggcatgaatgtggaaggcatttttcaacccactacttgtggaatagaagtccaggtctgacaaaataatatgttgtgcccacattctggcccctgtagccttgccaatccatgatgagaaagtgaggccccaaggtatagcctttcctactctattagtctatatcttcactttttgttgttgcaagcaagaaattagatttctcttgccttatcacttattttgagggaatattattgagctctggaactttattactttttaaaaaattctttcaatttgtccaaatgtcattgtactttgcaaaaattctttctcactgttagttacaaatagagccatttcttgggttaattgtgtatggaatttccttcactgtatgattttgtcttattgttgatttggaggcacttttatgaggtgagtgggaaaaacatgtattatacagtactactacatttactgaaagactacctttttttttcaaaagctgcctaatattttatctcacatatgaatcataatttatttagcaattcccctattaccctattgttgttttccagttataaataatgatgtaatggacataattatgcacatatctcagtgtggaaagattctcttgtttcctttggagtatgtttcttgctactgggaactatctgggaattaatctgtgtctctctttcatgagtgggatggagaggatgagtcttctctgctgatgttctcccatagatcactccacttctctcaataaccagtggtgagtctaccttatatgtaatccacagggagggccaatgggcctccagccttgtcttggctaaagtccatagcaaaagtattgttaccagggggtccttgctcccagagctcccaagatggtggccggccgcttccaaaatgggggtgggccacttccaagatggtggcaagcctcgtgttctctgacctggggttcttggcctcagatattccaaggaatggaatcttgggccatgcggtgagtgttttagctctattagaagccctgggtcacggaagagaactgtggaacccagtgactagtgttcagctcgattaggatgaacccaggcacatagctgtgcaggaacaatggcaagcctttagcctgactgggagtggcagtgggtgcctcgctggttcaggagcacagcagacaccctgctggatgccgagggatggaagtcagcggcgggtctgcaatggcagcaaacagcagtggtggacggtgagcaaaagctcagctcgagccataacaaacacggaccagaagagtgtagttgcaagatttaatagagtgaaaacagagctcccatacaaagggaggggaaccaaagagggtagccgctgccagctcaaattcctgggtttatatcctgatcattgtctctcccactgtgctctcaggcagtagatgattggctatttctttaccttctgtttttgcctaattagcattttagtgagctctctttactatctgactggtcaggtgtgagctaagttgcaagccctgtgtttaaaggtggaagtggtcaccttcccagccaggcttagggatttttagtccgcctaggaaatccagctagtgctgtctctcagtattaggaaataatcactgtttttttttcttaaatacttcaggttttattagttttctataaaccaagaacatatcagactgcagtagaggtcgtcctttattaaagataattctcttgcccctataaggagaggcccatgtagatctagagctgatagtggacaggttgtttgctaaaatattgaaatacttctataccacttggcacattatgtcatagtaacatgataagcagctaagttgatttataatataaactttagagtaaatttattagttgaagtgaaatattgtaggatgtctcaacaacccctgatatatgggccacctgccacaacatctaagaaatatttgtagctctatgactggttggccaatgtctagtaaacaatgcagatacgttgtgtattctttataaaactctgtattttgggagaagcaccagtttatcttcatcatggaattatagttcctattgcatctgaatagtttggtttttatttgtctttcatagctactgtgttgtaaatcttgtgtaagtgtatattatattgttttaaaaataaggtcttataatatactgaatacaaatacccaggatgaaggaacaacgaagtctggatatgtttctcaacatttctgttaaatacaatgaataagaattgtttggatctgtggtaacatggagaagaaatgatatcacaattatattattaaaaggtagaaatgttaaatgcttaaatattttatctgattaggaataatgatccattaaatctcttggtttaaacaaaggagacacaatcatttattaaaaaccatcaagaatgggcaaaataataaaaatgtttaaaagttttaaaaatcaaattcttgaaaaagtaaatgaaattgtgcggaagtccagaaaaataatggtcagttttaggcatcaatatttaataaaacttcagaaaaataataatgttaaaatggacatgctatggtctgaatgtgtgtgtacctcaaaacatatatattgaaatgtaattcccaatgcaatagtattaggagattgggcctttagggggtgatcaggtcatgaggatggacccctcatgaatgggattagtgcttttataaaataagtcctggggagcttctttgcctcttccaccacgtgaggatgcagaaagaagttgccacatgaagcagagagtgagccctcaccagacactgaatctgttgacactttgatcttggacttctcagcctctagaactgtatgaaaaaaaatttctattctttataagccaccccatttatggtatttttgttatagcagcttgaatggactgagacaggacacattgtgatatatatgtgtagttctggcttgttaagaagatatgtactgaaatgagaatgcttcttttggaaaacataagacagtaaaattttaattattattgacaaagcttcatctgctctatataaacaaacattttctttaaatgaaaaattcagtactttgaagagagaattgaaaattgctcttttgttttttagtcttgggatgctgacatataaaagatctataaaagtattttgttgatggtgcttgagaaaaattgatttcaatgaaatatattgacataaaaaccttactggactttacatagttgtaccagtgtaacgttagggagaaagtctggagttttaattataatttttaaaaaatctggatattttaatggggcactatttaagtaaccatattcaatcgcttatgattaatgccataaaaatataaaataaatgttttctcaataactttatatttactacttttcatcaaataaacatcagagagaattacccaataattcagaagagatgagaaatgagataataaaaattagagaaatatttgcacctcagttgtcagcttatggtgctagagttgaaaagcagtttggagattatgctattgttagaaattgtgaaaggccatagttaaattatttgagaaactaaaaagaatttggagcattggggtttctattaataaaataacttaattgagatataattcatatcccattaaattcatcttttaaaaatatacatttctcttgtttttagtgatgaaaaaatggcctttagtgaggaagaaattttatttagtgaagaagaaatgatattgacaataaactaatctggtacatcttccgatgttgtggaaaaatagtgaagcgtgagtcctctaacatcgttattttcagtattgttttggctattcagggtctcttgcatttacacatgaattatagagccagcttgttaaagtggatagcctgtgagagagtcagctgggattctgatagaaattgtgttgaactggtagatcaatttggagagaattgccattttaatattaagcctttccatccacaaacatggaaattacttatatttatttaggtcctctttaatttctttcaaaaatgttttgtacctcttgaaaaattttttaaatgaatatatactatttgtgcatatttatgggggtactcttttgttaaatttaatcttaactaatttattattttcaaagttataaatggaattgctttcctaatttcagttttcaattttccattgctagtatatagaaatataattgacgtttgtatattatatcctacaaacttgctgaacctgtttattcattctaatagcttttgggggagtccttaggatttcctatgttcaagatcctgtcatttgcaaatagagagtttaattcttcctttgtaatgaagatgctttattttcattttctaattgcactggttagaacctcaagtacaacattgaatcaaagtggtaagagctgtcttattcctgatctcagggggaaggcattcaatcttccaccattaagtatagtgctggctgtgcatatttcatagatggtctcatcaggctgaggaagctcccttctattcttagtttgttgagtgttttaatttttaatcataaaatcatgttagattttataaaatgcttcttctgtatcaaaatgatcatgtagcatttctcctttattctactaatgtggcatattacattaattgactttcagatggtaggagatttgattttaataaatgatattctaacagaaatgtcagcacttcctttaactttacaagaaagaaatgttttaattattaaagctgacataatttgacaaaccagcatagtgattgaacacagaatactaacatattattcttgactctggtcagcacaacatgatatgtggtataatggtgtcaataatggaataattttacataagtacccacctacatttcatggaaaatattgacacattttgactttgtcactcatcatattgacttaccctctttagctgtacattttctaaggatgcttatgttttacattgaggtagttagtataattgaacatgacaataccataaacagacatttcttgtgccatttttctagagactactatccaaggcaacataaatccattaatcaataccttaatgtttgattgtttatctaacaataaatttacccaacaatgatattatgcagagcaacattacttcaccttattaaaaaatgcattttaggagattcactcaaaatgaacatacatatggttgattctgttggactatgctctgtcagggcaagtacgttgtcaatgtgatggccccaaacctttgaatagtacctgacacatagaaggctcttaataaacatttgttgcctgagtgaatgaattcaatcccttgctgtgagcaattaaacatagtgagcgatcaaaacaagaaataaaaattaggttaccctgattggttctttttgaacctatgatttcaaaggcatctagggagtcaggctatgagcttgatactttttttttttttccactgttagattctggttttgtgtggcctaaagctcaaacactttcatgggtctgagttttaaaaaaaaaaaaaagcaaacttacttatagggcatttatagggttgggcaagtgtgggtccctgaggcttaagctttattatcttcagagtgaaatgtcactatagattcatgcttgttgaatgaatgaataaagtctttttttcctcctaaaaattaaagcaaaacttttgtattacctcattttactttgactttggctcttaaattagataaaattagaataggcataatattaatcaagtattaggataactctgactaaaaagagttaattttattttaaaaatataattgtctaggaaaactttagcaacaagtgaaatcctgaaatttaaagctataaggggtagagtggaatcagctaggtgtgaagactgggtaaacagtggaggagtgcacccgcagatcaggcatcgggagcttagcttctagccattaactaaatgtgtgatcttgagtatatcctacagaaattcagaaaatatgattagttgtagagtttatttgagtacaaagcttgagggcatgcacttgggaagcacagatttcaaagaatggaaatcaatgctttgaaatataaaggtttggggtcatttatatagacaggtttagggaagcttaagaaaacgtcaccatctttctatataaggtttactgtgtggttacaatgagtttaggatagaattggttgagatagtctttttctttcagtaaaggtatatttaacattccacagtgaagatataacattcatgagatcttctgagctatctgatctaagttagacagaacaatataggagagttaatctattaatataacaaaggtcagtgattagaaggggagaaggtctagtctctggtttcttctagtcatttaagaacaatgagaaagagagttaatccataatctaagaagcagaagttgcaactctgtgccatgcgactcacatcacagtcacagctctctcacaacttaaagtgttttggggattctaacagcttatagattttatttattttcacaagtaggtccctcctttctttgcagattcagttttctcacctgcaaaataaagactccgtactagacaaactgagactccatctgctttgaattttgatgcctgtttctaaatagatggatttgaaaactcatttctgtaatcacaaaatcacatgtcaaaacagacactgaaagagaaaacatagggagaaatgctaattttacactacatcttatatctcatttgagattttcctttatgttaaaaaagaaatgaaaagtggacttcatttgaattctgtccttttttggaaacaatcctgctgatctgactcttgaacttcataacccaagtggagttatttataatgccagtactttaagttagtaaagtggtgcatctttatggtaacaaggaacaaaaggaaggtgatagatttgaaatttatgtaagaacttggcttttgccatttatctgaacacgacatcatcttctagccttttctgttagtacaggaagttgtttcctaatttggttattcaatgtgatattttattttgcttttctcacatcctttagggagaactgatatgttagaagaaaaagtacaacagtggattctattagaaagaacaaatgagaaagaaattaggtatatttaggagaaaggataaaatgaatggctcaagtaggcttgtagctgcaaccaaatcaaaatataaaagggttactatgactacaaaggcagtatatttgaataaaaatggatatgaaagtctctttcacatgctaatcgaaattggaggaagtctgtcatttcaaactgcagacagtctttctccacctcttcttctacattatggcttttggattgaatctgctttaaacgaaactattgccctgtgaaactgaaaagcacttggagttcccttgtgtaagggctagtttacaccagttctagcactgtgactctgattcttcatttgttcagggtcagagcctcagaacccaccccactcgttttttgtttgtttgtttgttttctgatgaagaaaaagcacaatgatccacctgaaacatcttatctttaaggtataagtcatcccttctaaatggttattcctttcagttaattcagagaagacttatagagcaaattctaaatgcaaggcactgtggggaaagacatttgtggggaaagatagataatttggattctgctccccaaggactccctacagatggggagttactgagtaatctttttgggttctttctggatcttgcttcaggcacctaagaaatagccactgttccttgtagttaaacatagattgtgctggaaggtgcccgaaataaaaccagtatggtagtgtcagcattaccagatgacacagatgtacttgaattaactgcagtattctttctcatctctgataaatttaaaaaacatacatggattctgcttttaaaaggcatatgagtaatgaattggaacttactttatgtcccatgaaagaaatgggtgacatttacatagagtatttgactatagaattctttgcccttagaacaacagttaacaagtttaagaacaagagttttctgatttagtgtgggaaattgtgagaaaaatgctaacccgtccaaacccaaagaatggactcagaagcacaaaaaacagcaaaaagtgagacttttaatagcggttttgcaagatccgatggatgtctggtaggcagacacatccagggcagctacaacaggtaatttatctcctagcacacaagtccctcccccagttcctcattggttgagcactatggggttacagtctttcaggatatcgcctaagtttcattatcccccttataaggttataccccagttccattccctgcttaagttttgatttcccagtaatgaaactttcttcccttttatgggctgacccctcctctacattctgtttgcttattatgaccttctaggatcatgagccatgtgatgtgttacatccgcaggctggctgccagtgtttagatttaccatgccttacaaatggaccatttaaaatgttttcttacagaaatgaacatttcaagattatttaatgcctagatcataataaagacttactgaggatgggccccaatctccaaagattgaggttctgaatcttatttctggtccagtcataacctgtggttacatatttgcaaataaatgagttaatgagtatacctttggcttttttgtttttctgttgttaactttttaattatgtacatgtataactttaattttttttatacgtccacaggagtcatctgggtgatggaatgataggatagttttggttttctttctaatatctatgtattttttaaaatccatcaacagtggacttagaaaaagcaaaagaaaacaacaaaatctgttggatttctaaaaaaattacacaggtacagattaaatgctctgagatgcaacagagtaaaaataaataaagacgttaacatgttaaggatttacaaaactaacgtacctggtggaagattattttctcagtataccaaatgatacaggagttaagaagaaattacgtaggcagatagtgagggtatggaagccctccgtaaggatttttttaatgaaaagcagccccaaatcattttccttgctaacaacagcagcctataaaatcgagctgcagacatagatgcctgcagttgtgccaatcatgttcaagatggcggctctgtcttcccttctctttgtcagccacatgtacagtaaggagcggacaggatggcaggagccaaggggaaagttcattttcataataagattagggtggggcagccagccttcccctgcactatgtaaacgtcatacctgatcgaaccgatctgtgagccctatgtaaatcggacaccacctcctcaaacctgactataacttccgttgcatcagccacctgctggtctttcctcttggaagttccctctctctatagagagagctgttttactttctcttttcttttacctattaaacctccactcctaaactactcgtgtgtgtccgtgtcctaaattttcctggtgccagacaacaaaccccgggtatataccccagacaacgcagccacttcacaatgaagagtctgtagaatatttcagtttgggaaactccgatctagctcttggggcatagaggccacactgctggctagaactatagcaagcagcaaagagaaatttaactcagagagagtaagtggtatactgaagtctaaaagtggggagaggtggttccagggattagtgagggtagctgggacatccccagctccccgaggagcacctgtgctcatgccaggcacagtctcaggagaacagataccccagccactggaagtttggacatccacagcagagggtcctcagtgcatgagagtgagctgccaggtggagcaggtaaggttaatatttgcaggtattttatctgttaataaaaagtgtctgtttttagagactagtctttttaaaagaaaaacctgtgtaaataggaaataacacaaggaactgtgattaagccaaacagttcgagacaaaataggaactgtatcaggaacatgaagaactgatcggctctaatggtcactggaggaaatgggttcccacagtccatcggtgttacacatttccataactatgtaaaaagagggtacatctatgtgttccaagatgctaacttactttaatgtctgaagaaagagagctgattcagttaatgcgtccgcttaagtagccagttataaggaaaaccataataaaatccatagctcttttgtatacaactggtaacttgttagaaaacaaaatggacaatgacagtttatcataataattttaaaaactatgtaataaccaatattgaggataatcttaaaaaaatgtgtgaggtccaaagaaagaaatgtacaaaatttgtagcatagttgactagaaaaataggtatataaaatattaatcacatttttattctttaaaattttaaaataaaacatactgggaacgtttctaactgaaatgtttgaaaataaaattcttcttcttattctctccacaacctctttcactccgcagtgaacaatctgctatgtatctttcaaataagttacggactgaatgctcatttgccccacaaaattcatatgttgaaattgatgttattgaggtggggatttgggaggtaattaggacatgagggggaaccctcatgaatgagatgagtgcctttataagaagaggctgaagagctagctccctctctttctgccatacaatgagaaattgacagtctgcaacctagaaggggaccctcaacagagcccaaacatattggcaccctgatctcagacttccagcccctagattgtgagaaataaattctgctgtttagaagctacccagtctatggtactttgttatagcacaccaaactaaaacaaaatatttggagtatttatttcagttacattactgaacttaaatttgcaatgggttcatttacatataatgtaattacagttatatttgatttgatatatcaacttgctatttgacttacctatttttctatctttttctttcttttcctgctttctttggaattaatcaaataatttttattattccatttacctcagccttccaaagtgttgggattacaggcatcagccactgtgcctagcctctattaacttttatttttacatttattttttaccattttttcagaggttaatttcagcgtgcatcctcaattaattttagtcaaatatggattatcttttaccacttttctgataacattaaaactttagatacttttaacttaattatctctgtgcttttatattttatttctatacatattttaaaccttgcaagacattattattatcattgctttgtatactcaatatttcatttttaaaatctttttcattgcttttctttactgcctgcatttctgtgtttcaatctggaatagttttctttcgggctgaaaaactttctttagtatttctcttagtgcaggtttgctgataaaaattctgttttgtttatttgaaaacatctttattttgctttcatttttgaagaataatttcactggatatacagttttagactaaatgtaattttctttaatttctttcaatacaccatctcattattgtctggctttcagaagttctggtgagaaattactttccatttaattgttgttattgttgttgtatttgaagataacatactgttttttcttagctgctctgtggaatgatttctattttttcaaatcacttttggaaattcttcaatcctttaaaatttcttcaattttcccccatattcttttttctcttcttttgggaatccaattaaatttatgttaaactttgtattatgtgtattgtacattcttctaaattttatatcctgttttctcttagtgcatcactctaggtatttcccagcaatctatcttctacttcactaatgctctctattgctatctctaatctcttgttaaacccatgatttgaattcttactttcaggtattatgttttttagtcctagaactttcatttgattctttttatgaattctaattatataatacatttctttatctttttgtctgttttctctaacatattaatcttgccatttaaaaatctttgataactccaatgtaagaaccacctgtagttctacatctgttgtctaatttttctcttaattttgtggcatatggtactgtcttttggagtgtataataaatttgactgaatgtcaaatattgtttattactagatagcctccagataattttatctccttccagaaagtattcaccatttttttttgacagaaaaaattgggtctgataatcttattctgtttagccactttagtttcagtaagtgtctgcctacttccgttattctttgctcctaaggtgtatccctccagggctttcaacgaagagcctgatgtattttctgggcacctgaaacgtcctgagttctaatccttgcctcttagctgaaaactctgttctgttttccagaggctttctacttagctccttagtctcctgctcagtttagtttcagaatttggtaaatggttaaaagaggaaccagccacatgtcaggcttagttctctgcccctgccttcctcagagtttttggcccaggatatttctaattttgattttccagccccatgacacaatcaaaatctctactggtttcccagttagcagccctctgtttctgcaaagcctggaatctcaatcacctcttgccctggctcagaatgggcaaataccctcagagagaagcagttgcaaatgatcagctcaactcacttctccatcatcttcctctttttttttttttttttttttttgagatgcagtctcactctgtcacctaggctggaatgcggtggcacgatctcggctcactgcaatctccacctcctgggttcaagtgattcttgtgcctccctgagtagctgggactacaggcgcacaccaccatgtctggctaatttttgtgttttttggtagagaaggggttttgccttgttggccaggctggtctcaaactcctggcctgaaatgatctactcacctgagccttccaaagtgctgggattacaggtatgaaccaccacgtccagcccatcttcctcttttcaaaatttaatccttgttgtgatctgaatgtttgcatcccctcaaaattcatatgttgaaaccaaatcatcaaagtgatgatatttggaggtgggtgcctttgggacgtgattaggtcaggaaggtgcagaccccctgaatgggattagtgcccttataaagagaccataaagagctagctagtcctttccaccatgtgaggacatagggagaatgcaccatttctataaacctggaaatgggccctcatcagacagtaaatctcaggcaccttgatcttggacttcccaacctccagaagtgagaaataaatttctattgtttattagctacccaaggtcatagtactttgctataggggcccaaatgaattatggcatttcctatagttctagtggctttagtagccccttaatggctttaaacatatttgttgtttgttttatatttttgtttagcttttctaatggttcttattgggaatattggtctgctgtaagttattcatcatacccactgatatctcattgtccagactctataatatggtcatatctcacactgagaaagataattattttttattttgaatgacaatatgccaaataaaaatcaagattctgtcctcaggaaagaatggggagcctggatgttggggtaagcaactagcactctgttccaaagtgagaggtggaagccagttatagtctcatggaaggatagggagtggttttcacatatactggggaaatgagttgccagaatccacctctgacttacgagagctcataaaacaataataacttggttaacatttgttatcaaaatcatccaactctctatgttcagatccatgcttaccaaacaaccttgaggtagtaattgagctttccttagagacttggagagaatgtgctaatcctcagaaatgaatcttccagttcatttggcagttgtatttctaaaggtaaataatcaaaaccagtgtctagggccataatctgcatgatgaaccagtcttttttggctcactttgccctggataaaatgacaaaatatagtttcttgacctactagaacttgattgctgctgtgattctcttatgaaaatattgtcagcatttagacattaggaatctcttgctaaatttagcagcaggttcctgtctatgaagtaaaaaatgaatcctgtttagaaaagaatcttgaaaatgatgtctcagtttctaacagaaaggtaaaaaattttataagagtgatgaacactgaaaagataatgtctgaaaacagttttctccttatgttaggtttggaaaatgtggtcttgaaatttggtgaaaatacaactcacagagaattctaaaagactatccctcagactgattggtctgcaatttgggatttatgaaaaatgtttgctctttttaaagatagaggagaattatagattttggctaatcagagagaactttcctattaagttaatcactacaaaccctgggccctaagacacagaagagatttaaattctgagagtaagagctctcttggtacccaattcaattttatgggaataatcagatgattaagagaaaaaagtagtgactcaagaggtctttgggattctcctgcaaattctgaacaaggcacttaatttttcaaattctcatttcttccttttccaatctgttatggaagataaaatctggcctctgaggatacattgcttgtactaatgaaataataactggaaagattttgtgttcattggatgggttctgggacaatttccccaaaacctgttccttcctaattgtcagctcacttaaaattcagcactttattactgtttttgcatcattttgagtgctcatatcctttttttccttttaaaaccccttttaaatatttttagacactaatccatttagttcttaatcttataggctcagatgtatgccatggaacctatccctagaaaaatgcgttatgcacaaatccacaaacttttgcctgcagtttcaaaagagtcaccggctcttaaattaaaggagatataacacattttaaattctttcatatatatggttgttaagttttgaacactttgttaacagttaggctcttttgtatccctaaggatatattcctacttctgaatattttacttttcaccatttcaagttcataacatcacactggattataaaacaaagaaatatgtacaataattgtagcccatgtaatgggtaatggagtataagtattaataattccaataaattccatgttgggacaggtgtgattatccatgtattttttgccccttttttttttttttttttttttaccttaatcagaatgtgttatttcctgattgctttgatggcttttcccaggcttacctggtttgtgacaaccggctgctaaaatcaacaatcatgctgatttcttttagtttttcacgagtgtgctttcttactaggagtattctgtgcatgcttttccttctgtctttctttccttctttgcatagttaaatcctcctcagcctcacctagttggcgagtggctttcctccacatggttattcagggactcaggctctttctgttttgttactccactatcccctaggatcttagagtcttctacttcaagcaggggaaagaaagataaagaaagcattcatttataatatccttgacccagaagtgacacgcattacctccaaacacattctgatggtaagagctactcacatggctctacccaaggtgcaaaggtgtttgagaaatgggactcctgaatgaccagccacttcctagggtcatctcaacactgtggaaggggacacattaatttttggtggtagctacctgtattacaccatgcttgcattgctataaggaaacacccaagactgggtaatttataagaaaagaggtttaattggctcatagttctgcaggctatataggaagcatagcactggcatctcatctgcttcttgtgaagcctcaggaagcttacaatcatggcagaagatgaaggggagcaggcatatcacatggcaggagcaggagcaagagagggcaagggaggtgccacatacttttaaacaaccagatctcatgagaactcactcactatggcaagaacaccaccaagaggatggcactaaaccattcatgagaaactcactcccatgatccaatcacctcctacaaggccctacctccaatactggggattacaattcaacatgaaatttgggtgaggacaaacatacaaactatatcactacctatctctgccactccatgatgtaccacagcatgtagcatagtagcacttaataagtattcatagaatgcatgaatgaaaaaggaatgaatgcaattgtttgaagtagtttgtgattcgtattataacaatttcacatctggtgtacagaatttggagaagcacatactatcaaaataatcatctggaagacactgtgagttctcggtttcatatatcaaaatgcaccaggaggggcaacttcactcttaaatctctgcttcagtctgccagcttggatcattccacacatttatcaaaagaaatggaagaagcaactatagggagttatgcctgagactcctgcttgaattttatcctgcccatttcatactgtatcatgagttaattgcccaaaagaggcaaaagatagtataacatcagaacagaaaaagaaccaatcaaaagtgggtggaatttgggttaactgatcattgagcaaaccaacctgttcccattggatgactttatatatctatatgcaatatataaattatatattaaattttatgtatattcacttaacattttatgtatattcattttttatatattcatgtatattaattttataatggccatatgaagtattagagatatggaattaggcatatatagaacacatcaggaaactttttgcctcttctacattatagctaagatttgattataaaatatagagtttgattacgtggcaagtgaaattctgcttgcaccaaatccctaaatgttagccttataatgtatctttttatttatttattttttaagagacaaattcttgctctgttgctcaggctggagtgcagtggtacaaccatagctcactgcagcctctcactcctgagttcaagggatcctcctgcctcagcctactgagtgagtagctgggactacaggtacaccctactacatccagctaattttaaaatcttttatagggatggagtctatgttacccaggctggtcttgaactcttggcctcaagacatcctcccacctcaagtaatcctcccactttagcctcccaaagtgctggctttacaggcatgagccaccacactagcctataacgtatctttaaatatgtacctttactgaggagttaatctgataagattaacaaggactacgagatttatttatcttcaatctttggtgcaatacctggtgcattttagagtctccggccttgttttccacattcttgtaacattcctccagttcatccagctctgtttttcacaaagtctctaactcctacctgctacaaggtgcttcatgttctcaccagtcttaatttgtgtggctagctaggagagccagagaagcagagaatctgtaagctggaaaggacttcaacttcaatgggataaatctgctctttgatctgatgaatgaattcaaaataaagagttaaggacttcacaaactctcactgtttgctgacgatatgatcgtttaccccgaaaaccctaaagactcccccagaaagctcctagaattgataaaagaattcagcaaagtttctggatacaagattaatgtacacaaatcagtagctcttctatataccaacagcgactaagcagagaatcaaatcaataactcaaccccttttatagtagttgcaaaaaaatacttagaaatatacctaaccaaggagtcgaaagacctctacaaggaaaactacaaaacactgctgaaggaaatcatagatgacacaaacaaatggaaacacatcccatgctcatggacagatggaatcaacattgtgaaaatgaccatactgccaaaaacaatctacaaattcaacacagtccccatcaaaataccaccatcattcttcacagaattagaaaaaacaattctgaaattcatatgggaacaaaaaagaacctgcatagccaaagcaagactaagcaaaaagaacaaatctggaggcatcacactacttgatttcaaactatagtataaggccatagtcaccaaaacagcatggtgctggtatcaaaataggcacatagaccagtggaatagaacagagaatccagaaataaacccagatacttacagccaactgatctttgacaaagcaaacacagacataaagtgggggaaaagacacccttttcaacaaatggtgctgggataattggctagccacatgtaggagaatgaaactagatcctcatctctcaccttatacaaaaaccaactcaagatggattaaagacttaaacctaagacctaaaactataaaaattctagaagataacattggaaaaaccctcctagacattggcttaggcaaggatttcatgaccaagaaccccaaagcaaatgcaataaaagcaaagataatagctgggacctaattaaactaaagagcttttgcacggcaaagggaacagtcagtagagtaaacagacaacccacagagtgggacaaaatcttcacaatctatacatctgacaaagcactaataccagaatctatgacgaactcaaacaatcagtaagatcaaaatcagtaagaaaaaaacaatcccatcaaaaagtgggctaaggacatgaatagacaattctcaaaagaagatatacaaatggccaataaacatatgaaaaaattctcaacatcactaatgatcggggaactgcaaatcaaaaccacaatgtgataccaccttactcctgcaagaatggccataataaaaaaaccaacagtagatgttgacatggatgcagtgaatagggaacatatctacactgctggtgggaatgtaaactagtgcagccactatggaaaacagtgtggagattcctcaaagaactaaaagtagaactaccatttgatccagcaatcccactgctggatatctacccagaggaaaagaagtcattatttggaaaagatacttgcacacacatgtttatagcagcacaattcacaattgtaaaatcgtggaaccaacccaaatgcccatcaatcaatgagtagataaagaaactgcagtatatatatatatgtgtatatatatatatatacacatatatatatatacatatatatatatacacatatatatatatatatatatatatacaatggaatactacacagcaataaaaaggaatgaattaacagcatttgcagtgacttggatgagattggagactattattctaagtgaagtaactcaggaatggaaaaccaaatatcatatgttctcactgatatgtggaaagctaagctgtgaggacgcaaaggcataagaatgatacaatggagtttgggggtttggggggaagagtgggagggggcaagggagaaaagactacaaatatggtgtagtgtatactgctcaggtgatgggtgcactaaaatctcacaaattaccactaaagaacttactcatgtaaccaaataccacctgtaccccataacttatggaaaaataaaataataaatttaaaaaaaaattttaaaaaagaacttactcatgtaaccaaataccacttgtctcccaaaaacctatggaaataaaaagttttaaaaaataaaaaataaataaataaataaaaataaagagttagggacttcagaagtgatttgtaatagaaaaactttaattaaaaaaattaccagggtgatacatctgacacaaggtaatggattaatggtaaaagtaactaaggattctgtgtgtgtgtgtgtgtatttgtgtgtatgtacatgtgtctatgtgtctgtgggtgtgtacaggggattacattgctgagtaaagtttatgtgatcagaagaaggcctggacccttcaaatcatgctggactagattacctttgcttacaaatctacatgttctcagcatattcccattaaagagcttagttgtagcatttatgttttctgcaatatcaaggaagcagacacattttagaccccagcatcatatttgcataaaggagttctccactgaataaccaaatttttttctaagatgttatatttttgaaaaaatacttttatttcaaaacctctgaatggctttggcttgcttttgaaataaaatggtaaatttttttagtggatagtttctgaaggattgttatgtaggagagctttacatataggtgtgaaaacagccaatttaactgcctacacttctgtatcccccagagtcatgcctatttgtactgcactgtgaggattcagaaacagagagaaaaagctggtgctaaatctgaggggtaaaaatggaatttgattcccaaaatgaaatttgatcacatagaatttgtaatctagattctgcatctagaatacagaaataaatgcacagtgtcttcattttgtttaattaacatattagtgatgattgtccctattgctgtgcatcttatagattgtaaacggatttattttttgcctttccacctggatttggaagtactcaaaagaatctattaagaatgtgatatccctgtgatcttgaaagatacaaacgagaacaggactggctgaaaaacactcagaatgctctgtttgataattgggagtagaacttctgaagtcttaatgatccaggccaagatttaaatcttaactttttatcagccttcagtgtttttaatctaaggaataattatcttcctgtatttctatttcttagatcagaatttttaaatgccatcctcattaattttctaataagatttaagttgaaacaatgtacaatattgtatatcctaactttcttacaaggggcaggaagcaaggttatgtgcatggccacgtgtttgtagatacatgtgttgaaataggaagtatcctagtatgtatttagataagaaaaacttacatactagtgttgactttgaaattataacatgtatacctacatattctttgtgtttattttgaagttttgaaaatatacaggactgttaataaaaaaagaatgtgatatcaattttatgaaagccctcacctgaggatgctggggacttgatatagtgtgcaagacatttaatggtatgaggcatcatctatagcagtggttcccaacattttaaaatacaaggtacattttgaaactaagaaaagcatcaccagctattgtgtgctggaagttgtactttttgcatctattgattgaagaataacctagtgataatgcctattcttagtaatgctttaagttgtatttacatgttattaataatgatagaatcagcatgtttttgtagaagtacaagaactatgtatgaggggaatgttatccatgccaatcaggcttggcctgcattttaaacttgtagaccctttaacggcttgtcacctatggaccagacagtgctggcttagactaaaaatatataattgatgataggaatcttttcagttgttatgaaaattatttcttgacaaagtcctgagagctttaagtaaaacatttctttcagggcctgtgactgatgctggtcttactctccccaccgatgtctcatcttttcttgatgcaaaatctgacctaatcccatgtgaatctaaaggtttatctttgctggaatgatactcttcaccatgaagttgcaattagattggtgttctgttgcaccaaaaaactggctagggaaaatatcaggcctgattaattaactaggtaatgtgctgaactacagcccactttgcaatgtctctgagacgatgtgattgcataggctaatggaaaataagtttatgggctcagaatttaaaaataagactattgtttacaaggacttcatcacagaatgtaagggagtgctcactagtcagaggaaaggtatcatcatatcctagttccttaacacattaaaatgataagcttacttccattcatgcaaaaccacgggccccttctccaaaaagctggagaagaaaggcctccagagacttggataaaggcagcctccttccttcctcttctccttctcaggagtcagagctgcacagctatctaaaactcacccacccttcccactcctccatcttcccctctttaacaggaatttccccagtaaaatcttttccaattctagtcccttctgggcatctgcttctccaaagaccagatctgccataccacttattagcttggttgagctacttaatccttgtaagtatgggctatcttagcagaacacaggtaagataatggtatttagatccccctatatgttttttatttttacataatttcagatttacagaaaagttgcaagaatagtgcaaagaatttatgaataccctcacccaggttccctgtattaacattgtgtgtgtgtgtgtgtgtgtgtgtgtgtgtattcacaaacacataattttgaaccctttaagaaaaagttataggcgtgatattcctttacttctaaatatttcagcttgtgttttctaaaagtaaagaattttcttacttaataataatcacagtataatgcttaatcaaaaattaacatcaagctgggcatggtggtgcatgcctgtaatcccagctactcaggaggctgaggcaggaaaatcgtttgaaccagggagttggaggttgcagtgagctgagattgcaccactgcactccagcctggcaatagagcaagactcagtctcaaaaaacaaaacaaaacaaaacaaaacaaaacacatcagacgagatcaggagtgttgagagtggtatgctgagcccatatagccaacacagtcctaagcaaaaagaacaaagctagaggcatcttgcttcctgacttcaaactatactacaaggctacagtaaccaaaagagcatggtactggtaccaaaacagatgtatagaccaatggaacagaacagaggcctcagaaataacaccacacatctacaaccatctgatctttgacaaatgtgacaaaaacaagcaatggggaaatgattccctatttaataaatggtgctgggaaaactggctagccatatgcagaaaacggaaactggacccctgccttacaccttaaataaaaattaactcaagatggattacagacttaaatgtaaaatctaaaaccataaaaaccctagaagaaaacctagacagtaatattcaggacataggcacggacaaggacttcatgtctaaaacaccaaaagcaatggcaacaaaagccaaaattgacaaatggtgatctaattaaactaaagagcttctgcagagcaaaagaaactatcatcagagtgaacaggcaacctacagaatgggagaaaattgttgcaatctatccatctgacaaagggctaatatccagaatctacaaggaactcaaacaaatttacaagaaaaaaacaaccccatcaaaaagtgggtgaaggatatgaacaaacaattctcaaaagaagacatttatgcagccaacaaacatatgaaaaaaagctcatcatcactggttattagagaaatgcaaatcaaaaccacaatgagataccatctcatgtcagttagaatggcaatcattaaaaagtcaggaaacaacagatgctggcaaggctgtggagaaatgggaatgcttttacgctgttagtgggagtgtaaattagttcaaccattgtggaagacagtgtggcgattcctcaaggatctggaactagaaataccatttgacccagcaatcctattactgggtatatacccaaaggtttataaatcattctgttataaagacacatgcacgtgtatatttattgtggcactgttcacaatagcaaagatttggaatcaacccaaatgcccatcaatgatagactggataaggaaaatgtggcacatatacaccatagaacactatgcagccataaaaaaagatgagttcatgtcctttgcagggacatggatgaagctggaaaccatcattttcagcaaactaacacaggaacagaaaaccaaacactgcatgttctcactcataagtgggagttgaacaatgagaacacatggacacagggaggggaacatcacacaccgggcctatcagggggtggggacaaagggaagtgaagcattaggacaaatacctaatggctgtgaggcttaaaacctagatgatggattgataggtgcagcagaacaccatggcacatgtatacctatgtaacatacctgcatgttctgcacatgtaccccagaacttaaagtaaaatttcagaaaaagttaacatcaattcatttctattatctaatagccattgttttaaccattgtctcaattatatcttttatagcaatagaaagtccaagatcaggctctagagtttcccttttattttgcctggagtaattctataaataatttagtaagtgctcactaagtgccaggtgggcactgacaagactaaggtggggaacaatgggtcccattgaatgaggaacttatatctactctggggaaatagacacctgacaactagtttatgatttaggctgtagtgtggtaggtgtggagattcaatggggactcattcaatatgggatatagggtctaactgagcttatatctactctggggaagtagacacctgataactagtttatgatttaggctatagtgtgatatgtgtggaaattcaatggggactcattcattctgggatgtagggtctaacttcagcatagaaggtagaaatagcccagttgcagtcttacgtcctgccccacaacaaattcagagcagccagattgtgtctcttgcactagaacagattttttttttcagttaagaagctgacaaagtaattattttgcttgtagggatcatgttgtctaaaaaataatatttttaaataccaaaatcaattttatcttggtaagaggctcactcagtaagaggcacatgggaaaactgaaacccttaaaagtgattcaggcaggtccattgactcaagatctctctaggcacatgcctattgcccattgaggtgtgaattacctccatgggttaaattgttgatgtagtttctgttaaatatagaatatgactctgaatgactattctccttgctcaggggatggaaaatgattaaaacaaaatgcctgctctgaatgcaattaaaccagggaaaataagaccagaacaaaaatgatcataacgcaaaatatgacagaagtagtttcagaagaatgatgcattgcaaaaaaaaaaaaaaaaaaggctcagcaaacacttcatggaagaagtggcatttaacatgttcattaaaagaagaaaagatgttttctggatacagtaggggagttaccttctgttatggtattagcataggttaagaaatagagacaggaaagcactagagtgaatgggatatccaagtgtaggcaagagggaggagtcccattcagcaagatcttctgggacttgaggtatttgtgagagaatagagaaaggcaagattgtcttacttgattcatgctgccacaaaaaaatacccaagactgggtaatttataaacaacagaaatttatttcttacagttctggaagctgaaaagtccaagatcaagatgctggcacacctggtggctggtgagggccgtctctgcctgcaagttggccccttgaaaactacttcttctggaggggacaaacactgtgtcctcacatgaagaaaggatccgaaggagtgaactcatcccctcaagccttttaataaggcattaatctcatccataagggtagagccctcatgggccaattactttctagaaggtccacatctcagtactgttgcattagggatttagtttcaacgtgatttttggagggaatgcaaacactcaaaccatagcaaggatggagagagattcagggcagattgtgaagcaccttggaatgtggtctccagtgaatctcctcctggttccatgtgtgagtcctgggagcagtttgtttccctccttactgtatcttctccttttcctgtactccctgcttttcttgctcttttctcttgatatatagagacattttcaacagagttctttgccaggtaggacagactttcctacactcttgcttcccacacactcagctctaacccactttgttaaaatacaaactttttcatgtttctaagttgtcacaaaaccaccagcatgagggacactaacacacacacaaggctgagaggagtcatgtgggtcatgtgaggaataggccgtgcatcagctttggtctgtcgtctcccaacaatgcatcttgatgagataagtatatgaagctctgattaggttcaatattttagtcaaatgagctgtttacctccactccccaatgtgtcagtgtagacgcaagatgacttggatgaatatgttagaaactttgagtttgcaggggtgctttcttcctgagaatggcaaattagggctgctctgaaaagttaccctagttttgttttcttgttaggaacattcaaatgagcatgaagaaagagcaaatacttaccagtggtaatttaaaaatgtatatatatatataaaaattagctttattgccatatttctttgactctaagatgtacattttcatatatttttacatttctggaatggaagtaaggctacatgcatgtttaatgtggcatctctgtgttttccttctgttctacctccctccctcattctgcaaatcaaacaaacaactcaaagctctcattaaattgctgtcttacaatcaagggaataagatgatattttctagttcctcactcctgtcccccagagacaccttttctgcttattagctgggtgagaagaaatcatctactttaaaatgtcctactgagggttaagcatccttcccaagaggatgctaccaactctggaatcacccatatataagacatgtctagactatttccatcagctgaggccctttcttctcctgaaaattgagattcatctgagtaattctcacatgtgcatgtcctctgccatccaactgtcctcctcagaggcttcatgacagaaagcagcgagggattaatttttaacaacccagcctggttttatgacggtcaacattattattttttaatgtacaaatagtcctatgatgattccattacaagtagaagtgcaggcactttggtagattggtatatttatccttaacaaaactaaatatggatacaaaaatacagtgaatgaaatctagtattgaataagatctagtattcagtagcacaacagagtgaccatcgtttgcaataatttattgtttattttaagataactaaaagaatggaattgaaatgttcctaacacaaagaaatggtacatgattaaggtgatggaaatcccaattattctgatttgatggttacacattgtgtgcctgtatcaaaacatcacatgcaccccataaataataactatttattacccatacaactattatttacccataataattcaaaataaaaaattaagaataaataaaacaaaccaaaagaacctgaatatgaattaaatatttttaaaaacaggaaatgagtttctgttctcagtactctgtgagtaaattcattaatgagaggggttcatatctaggttcacattgggactgggcaaatcatatcctgttcctgcccttactctccccacccccaacgacctcgagttttaaaactggataaaatctggtggcagtgcacagattggacagctgcaaggaattacaaaaagtgaacaggtgtcacaaaataacacattgcttgagggggtgggtaagtggaggggaggagatgttggcaagtcatccagcatcagctgctttgctgaagttgtgtgtgggattagcagaggggagggtctgcttgctgctcaggctcagagaagccttggctccatcccaacatcctatttgcaatctaggtggggctattttaacaagttcagcaaatctccctccagatccctaatggacaccctgcagccctctcctctactgcctactaattcccagaccgactggcttcctctctcatacttttacccacccttccttttcatctttaaccctttgctcgaactccttttggtctctacacaagaaatctaactttccttatcaaattcccatcatggagacaataccttcttcatgtacctgaaactcacggggtatgagggtttgcatagctcttgtttctctgtgtcacttttcttgctacctctgccctctctttcaagactctttctatgaagtccatagggtgcacttgcaatggccatatgaaggggcacagagagcagtttggagcaccggtgtggttgatatagcttcccccactcagaggtgataagacctaagagcacattgggtggttgagaagactaaatgatttgctattgaagagcatctgacagaggacctggcatgttgcaagcactcaatgaatgatttgaaaggcattgacatggtttggccaatgccttttaagtagaaaatggaacctaaaaagctctttaatttttcccaccttaccgcagctgttagaaagctcaggaaatttctttcttttttccccttaaaaaaaaactataagctgggcatcgtgacttgtgcctgtaatatcagctattcaggaggctgtggtgggaagatcacttgagcccaagagttagaggctgcagtgagctatgtttgtaccactgttccaggctggatgacagaatgagacattgcctctaaaatatagatatatacttaaagttttatatatatatgtgtgtgtgtgtgtgtgtgtgtgtgtgtgtgtatatatatatatacacacacacacacacacacacacacacacatatatagaacttttttaaacttcaattcttctggtgtaattattcatttccttcctttctctttttattaaagtttgagattttattttatttggattctccagtttcaatctttctttctttcttttttgatataagaggaagagtaaataaatacaacctgaaacaatatcagcctacttggctcccttggccacccaagggcaagggcagatgggtgatgagggagccagtccacggtggatgagtttttcttgtagttttccagcagagttccaagttatctctccagggctgccatgcaggccttgaggccactttgagtagagcccactgacatcacctatctgagatactgggttttatggctaaaagaaattgctagacactttgttttgtttcacatatgtcaggatatccttgccccaaggaaagtaagttctttccaaaaactcctcaggaatctggggcctttttaatcaattaatatattttttacattaacacatttgatatatttatttgccatgaggcattatgtcagattttgacatgcattaatttgttagattctcaccataccactgtgagataagaattagtagtagctacattttacaaatcaggaagctgactcttagaaaggttatataacttatcccaaatgacacagctacgagttggaccaacaatcattcattcgaaacctcaatccacaataacactggtatatttcagggtagaatgaaattgactgaatcttccaggagtcttccattctatgaaccagcaaggccacaaaaagttcatctgagcagctctgcagtgtggcagatcatctagacccggcagactccagactcctgcctttccctaactggacattgcagggactctgaagatttcagcattgatgcatgagccaaagagccaagcagaggacactgaatgaatggtgtatgcctgactgtcttagtctgttagtcctgctataacaaaatacctaagactgggtaatttataagcaatagaaatatatgtctcacagttctgggggctggaaagttccagaccaaggcatcagcagggttgatacctatttggtgaagggtattctctgcttccaagagggtgcagtgttgcgacatcctccagaggggaggagcactgtgtcctcacttggtggaaggaaaggaaaggaaaggcaaaagaatgcctcctttaaccttgaacccttttataagggtactaatcccattcatgggggttctgccctcatgacttaatcatctcccagaggccacatctcttgatactattgcattggggattaagtttcaacatgagttttagaggggacatcatcattccaagcatagcactgactgtaagaaattctggtcactagctagattaagtaccttatgcattgtagtctggctgccaggggagagtgcccattcaagaccttcttgtgtttttcttctcctgaaagtctgtatgaaaataaagtccactgttttttatagctcttttaaaattcccccaccactctcactctttaactatcctttccacatgaaatacctccttcctgctggcagataaaataaggccacttataagccatattgaaacttgaagaaaaaaataagcatgcatttttaaagcatgtccctaaataaatttgaaatcaaatcagttcaaacaactgtagtgctacaaatatcataagattctcgatgacactgcttcataggttttttatttccccaacagaatttttaaaatgatttctaattaggaagacaacattgtctttaaaattattcagtgattcagagacaaagaatacaaaaggacaaagacttctggtagtgagaaaaaaatctcaagccttcaccatgccaaatatttattttccttctgaaacaatgttattgctttccaaataaagaaaccatttagagccaagatatgccattcaaatcataattgcatttccttgctaaacttagaatagaagaatgtattcaataaaaatgttagtaactctagaagtaaacattttgctcatgatacatatcaaattaaaaatactctagcataatgaaaaagatagcattgctgatccagcattagttggacattgttttttgtctgtttgttttgttgtttgttgtgaagtctgtagtagtgcaatagatttagatcacatctttgcctgtctgtactctctcacccaggcatttccagagccatgaaatgccaaggcatggtcagagaggccagtttcagaataggcagaatctaattgcctcagaaagagaagaaatcccagattttggtctggtgagcagagcattccaactgtaacccaaacaccagtaccatttagaagttaaagaaacccataatatatgtcttcaaagtaatttggctgattttaaatgactaactacttcaagttgtatcagtgaatgttatagttctatatacaaacctacttaattaaacatgttgtaagccagatatgagtcatttaaacaagtgattagtaacggattctgtcaaaatgatcaaccaagtcatgttgtgtagactagaaatttcaaaagtaaggtcagggacgaaaacaagaaatggggaaacgattccctatttaataaatagtgctgggaaaactggctagccatatgtagaaagctgaaactggatcccttccttacaccttatacaaaaattaattcaagatggattaaagacttaaatgttacacctaaaaccataaaaaccctagaagaaaacctaggcaataccattcaggtcataggcatgggcaaggacttcatgtctaaaacaccaaaagcaatggcaaccaaagccaaaactgacaaatgggatctaattaaactaaacagcttctgcacagaaaagaaactaccatcagagtgaacaggcaacctacagaatgggagaaaatttttgcaatctactcatctgacaaagggctaatatccagaatctacaatgaactcaaacaaatttacaagaaaaaaacaaacaaccccctcaaaaagtgagcaaaggatatgaacagacacttctcaaaagaagacatttatgcagccaaaagacacatgaaaaaatgctcatcatcactggccatcagaaaaatgcaaatcaaaaccacaatgagataccatctcacaccagttagaatggcgatcattaaaaagttaggaaacgatattgggagccaagatggccgaataggaacagctccagtctacagctcccagcatgagcgatgcagaaaatgggtgatttctgcatttccaactgaggtaccgggttcatctcactggggagtgccagacactgggtgcaggacagtgggtgcagtgcactgtgtgtgagccaaagcagggtgaggcattacctcacacgtgacgtgcaaggggtcagggaattccctttcctagtaaaagaaaggggtgacagacggcacttggaaaattgggtcactcccaccctaatactgcgcttttccaacaggcttaacaaacggcacaccaggagattatatcctgcacctggctcggagggtcctatgcccatggaacctcgctcattgctagcacagcagtctgagatcaaactgcaaggtggcagcgaggctgggggaggggcgcccgccattgcgcaggcttgaggaggtaaacaaagcagcagggaagcttgaactgggtggagcccaccacagctcaaggaggcctgtctgcctctgtaggctccacctctgggggcacagcacagacaaacaaaagacagcaataacctctgcagacttaaatgtccctgtgtgacagctttgaagagagtagtggttctcccagcacgcagcttgagatctgagaataggcagactgcctcctcaagttggtccctgacccccgagtagcctaactggggggcacccccaactaggggcggactgacacctcacatgtccgggtactcctctgagacaaaacttccagaggaacaatcaggcagcagcatttgcggttcaccaatatccgctgttctgcagccaccactgctgatacccaggcaaacagggtctggagtggactgccagtaaactccaacagacctgcagctgagggtcctgactattagaaggaaaactaacaaacagaaaggacctccaccccaaaaacccatctgtacgtcaccatcatcaaagaccaaaggtagataaaaccacaaagatagggaaaaaacagagcagaaaaactggaaactctaaaaatcagagcgcctctcctcctccaaaggaacgcagctcctcagtgcaatggaacaaagctggatggagaatgactttgacaagctgagagaagaaggcttcagaagatcaaactactctgagctaaaggaggaagttcgaaccaatggcaaagaagttaaaaactttgaaaaaaaattagacgaatggataactagaataaccaatgcagagaagtccttaaaggacctgatggagctgaaaaccatggcatgagaactacatgacgaatgcacaagcctcagtaaccgatgcgatcaactggaagacagggtatcagcgatggaagatgaaatgaatgaaatgaagtgtgaagagaagtttagagaaaaaagaataaaaagaaatgaacaaagcctccaagaaatatgggactatgtgaaaagaccaaatctatgtctgattggtgtacctgaaagtgatggggagaatggaaccaagctggaaaacattctgcaggatattatccaggagaacttccccaatctagcaaggcaggccaacattcacattcaggaaatacagagaacgccacaaagatactcctcgagaagagcaactccaagacacataatcgtcagattcaccaaagttgaaatgaaggaaaaaatgttaagggcagccagagagaaaggtcgggttacccacaaacggaagcccatcagactaacagcggatctctcggcagaaaccctacaagccagaagagagtggagaccaatattcaacattcttaaagaaaagaattttcaacccagaatttcatatccagccaaactaaacttcataagtgaaggagaaataaaatactttacagacaagcaaatgctgagagattttgtcaccaccaggcctgccctaaaagagctcctgaaggaagcactaaacatggaaaggaacaaccagtaccagccactgcaaaaacatgccaaattgtaaagaccatcaaggctaggaagaaactgcatcacctaatgagcaaaataaccagctaacatcataatgacaggatcaaattcacacataacaatactaaccttaaatgtaaatgggctaaatgctccaattaaaaggaagagactggcaaattggataaagagtcaagacacatcagtgtgctgtattcaggaaatccatcacacatgcagagacacacataggctcaaaataaagggatggaggaatatctaccaagcaaatggaaaacaaaaaaaggcaggggttcccatcctagtcttggataaaacagactttaaaccaacgaagatcaaaagagacaaagaaggccattacataatggtaaagggatcaattcaacaagaagacctaactatcctaaatatatatgcatccaatacaggagcacccagattcataaagcaagtccttactgacctacaaagagacttagactcccatacaataataatgggagactttaataccccactgtcaacattagacagatcaacgagacagaaagttaacaaggatatccaatgattcaactcagctctgcaacaagcagacctaatagacatctacagaactctctaccccaaatcaacagaatatacattcttttcagcaccacactacacctactccaaaattgaccacatagttggaagtaaagcactcctcagcaaatgtgaaagaacagaaattacaacaaactgtctcttagacaacagtgcaatcaaactagaactcaggattaagaaactcattcaaaaacactcaactacatggaaactgaacaacctgctcctgaatgactactgggtacataacgaaatgaaggcagaaataaagaagttctttgaaaccagcgagaacaaagacacaacataccagaatctctgggacacattcaaagcagtgtgtagagggaaatttatagcactaaatgcccacaagagaaagcaggaaagatctaaaattgacaccctaacatcacaattaaaagaactagagaagcaagagcaaacacatttaaaagctagcagaaggcaagaaataactaagatcagagcagaactgaaggaaataagagatataaaaaacccttcaaaaaatcaatgaatccaggagctggttttttgaatagatcaacaaaattgatagaccactagcaagactaataaagaagaaaagagagaagaattaaacagacgcaataaaaaatgacaaaggggataccaccaccgatcccacagaaatacaaaagaccatcagagaatactacaaacacctctacgcaaatgaactagaaaatctagaagaaatggataaattcctcaacacatacaccctcccaagactaagccaggaagaagttgaatctctgaatagaccaataacaggctctgaaattgaggcaataatgaatagcttaccaaccaaaaaaagtccaggaccagatggattcacagccgaattctaccagaggtacaaggaggaactggtaccattccttctgaaactattccaatcaacagaaaaagagggaatcctccctaactcattttatgaggccagcatcatcctgataccaaagcctggcagagacacaaccaaaaaagagaattttagaccaaaatccttgatgaacattgatgcaaaaatcctcaataaaatactggcaaacagaatccagcaacacatcaaaaagcttatccaccatgatcaagtgggcttcatccatgggatgcaagcctggttcaacatatgaaaatcaataaatgtaattcagcatataaacagaaccaaagacaaaaaccacacgattatctcaatagatgcagaaaaggccttgacaaaattcaacaacccttcatgctaaaaactctcaaaaaattaggtattgatgggacgtatctcaaaataataagagctatctatgacaaacccacagccaatatcatactgaatggacataaactggaagcgttccctttgaaaactggcacaagggccgggtgcggtggctcacgcctgtaatcccagcactttgggaggccgaggcgggtggatcatgaggtcaggagatcgagaccatcctggctaacaaggtgaaaccccgtctctactaaaaatacaaaaaattagccgggtgcggtggcgggcgcctgtagtcccagctactcgggaggctgaggcaggagaatggcgtgaacccgggaagtggagcttgcagtgagccgagattgcgccactgcagtccgcagtccggcctgggcgacagagcgagactccgtctcaaaaaaaaaaaaaaaaaaaaaaaaaaaaaaaaaaaaagaaaactggcacaagacagggatgccttccctcaccactcctattcaacacagtgttggaagttctggccagggcaatcaggcaggagaaggaaataaagggtattcaattaggaaaaaaggaagtcaaattgtccctgtttgcagatgacataattgtatatctagaaaaccccatcgtctcagccaaaaatctccttaagctgataagcaacttcagcaaagtctcaggatacaaaatcaatgtgcaaaaatcacaagcattcttatataccaataacagacaaacagagagccaaatcatgagtgaactcccattcacaattgcttcaaagagaataaaatacctaggaatccaacttacaagggacgtgaaggacctcttcaaggagaactacaaaccactgctcaatgaaataaaagaggttacaaacaaatggaagaacattccatgctcatgggtaggaagaatcaatatcgtgaaaatggccatactgcccaaggtaatttatagattcaatgccatccccatcaagctaccaatgcctttcttcacagaattggaaaaaactactttaaagttcatatggaaccaaaaaagagcccgcattgccaagtcaatccgaagcctaaagaacaaagctggaggcatcacgctacctgactttaaactatactacaaggctgcagtaaccaaaacagcatggaactggtaccaaaacagaggtatagaccaatggaacagaacagagccctcagaaataatgccacatatctacaactatctgatctttgacaaacctgacaaaaacaagaaatggggaaaggattccctatttaataaatggtgctgggaaaactggctagccatatggagaaagctgaaactggatcccttccttacaccttatacaaaaattaattcaagatggattaaagacttaaatgttagacctaaaaccacacacacacacacacacacacacacacacagattagcagggtgtggtagcacacgcctgtaatcccagctacttgggaggctgaagcaagagaattgcttgaacttgggaggcggaagttgcagtgagtcgagacggtgccactgcactccagcctaggcaatagagggagactctggtctcaaaaaaaaaagaaaaaaaaaagtgttttgttattttcagtgtacaagtctttcacctctttggtgaagttaatttctaagcattgtattctttttaatgccattgtaaataaaattgttttcctaatttaaaaaaaaaaaaaaaaccctagaagaaaacctaggcattacccttcaggacataggcatgggcaaggacttcatgtctaaaacaccaaaagcaatggcaacaaaagccgaaattgacaaatgagatctaattaaactaaagagcttctgcacagccaaagaaactaccatcagagtgaacaggcaacctacagaatgggagaaaatttttgcaatctgctcatctgacaaagggataatatccagaatctagaatgaactcaaacaaatttacaagaaaaaaacaaacaacaccatcaaaaagggggcgaagtatatgaacagacacttctcaaaagaagacatttatgcagccaaaaaacacatgaaaaaatgctcatcatcactggccatcagagaaatgcaaatgaaaaccacaatgaggtaccatctcacaccagttagaatggcgatcattaaaaagtcaggaaacaacaggtgctggagaggatgtggagaaataggaacaattttacactgttggtgtgactgtaaactagtttaaccattgtggaagtcagtgtgtccatttccttgttgctatttctgtttcagcaacatgctcagagatagggatgatttctattaggtgtaatggcaaagtgcttcttccattcttgctgtacccagggaatgctgttaggtactatagtctggattatatttttctttttttttctgtatttctctatatagaaccacctgacacattcttttgtgtagtggattgataatataattcatgtagcaaatatattctaaaaacagaggaacaataattacaatcgtttgaagtaaaggtcaaaatctgaattcgtttgaaagtgacggaggaagatcatgaaatttagggactttttacagttaatgaaagtgttcccttcaggctccaaaacacagctgaactgtagcaataatttcaagaaattatagtagtaatgagctgcataataatttttaggtcaatgacagaccacataaatgagagtagtcccataagattataatggagctgaaaaattcacctagtgatgtcatagccattgtgttaactgcctacagtattaattacagtagcatatactgtacaggtttgtaacccagaagcaataggctataccatataccttaggtttgtggtaagctatatcatccaggtttatgtgagtacactctgtgttgtttgaacaatgatgaaatcacctaaggatgcatttctaagaatgtatacccatcattaagtgatgcatgactgtgtatcattttcagaatggcaaaatagaactcaaaacataacaaaatcatgggaacttaaaggagaattgaatttgtgactcaaagactctgcatagatggttaattgtagtcattcataactcatttttaacagtattcctgtacatagactttctttaaaagtaatggaggtaaacactactatttccctaggtagcctctttcaacaatttacgatccttataactgcgactctttctagaattaaaccagtacccaggcttgaacagcagtagtcataatgagaaataacaggattagaaaacccacactaaaaatggaaagaggaactacaggcctcttaattcgaaatgtttgaggagagacttaatacttcccaatttccctattcagctatacaggagcttttcctgggcccttagctaatctcttttatgacttgatttctggggaatgaccttgaatttttcttctggtttaatgaacagatattcatcaaattgggattacagattgttttgtaactttatatttattttgcatttaaattggtatccagtttttcattgaggtaaaatttacataggatgaaatgtatttattttaagtgtgtcattcaatgagttttgacaagcgcatatttctgtgtgacctccaccccaatcaagcatacaacatttctatcaccctagaaggtacccttgagctcccttcccctctctctgatttttatcatcttaacgttagttttaccagttacagaactttatagaaagggagtcatacagcatttacctttaaactggcttcttttgctcaacatttttttaaagaattatccatgttgctgtgtgtatcaggagttaattcctttttattgatgagtaattttccattgtacataagggaatatatatcaatcttcctgttgatgaacagctggatggtttatagtttttttttatgaaccatagacttttcaatcaccattggcttaaatgaacacaaagaacatctaagttttctataaccactcaataaacacgtatttattaagagcttactctgagccaggcattattttaaatgctgaggatgcaaaaatgaacaaaaaagcatctctgtttttgtggagattgttttctggagaagagactaaaaataagtaagacagatataacattatatgtcaataagtgttatggagtaaaataaggcagagaaggggaatagggagtgtgaggtgtccagggatgccatcactaaggggatggcatttgggcaaagacctgaaggagatgaggggcaagtcatctggatatctgggaaagaagcatccttggtaaaagaagagcaaggtgaaacccttcaggcagacacatacctggtcttttcaatgtgcataggtgaagtgcccctcaaagggattggtagatgatgggttaggggagggcataatgtgctaggtaggatgacatgccagttatcaatttattacctctcagctcttaattcacctttttggcctgttctttgaaattggatctgtgccctttaaatagtttttccttgccaggtcacactgaagctttgtcaagtgaggacactgaataggattggaatattggtaacaaggaagtctggggaagaggtatatggctggatctctctgaatggacacagactgcagatatttgtacccaatatcaatgctcatcaacaggcatccattgcagaggagactcttaataatcaggggggcataattattcattctgtggatatcagtaacaccagccaccctagtgcttattgggcccatgaataaagtgtctatggtggcagggatggaggctaagcatgggcttaacagcatgaacttctccttatgaagaattatctgtctaatattactgttgagtatccaatctgccaacagcagataccaagatggaatcctggatatgccaccattccctgtgggaactgaccagtcacctggtgacagattgattacattagacatcttctattatggaagtggcagagattcatcttcctaggaagcatacatattctaaataagaatttacatttcctgctcataatgcttctgtcagcaccgcatccaaggaccctcagaatgccctatccatcatcatggatttctgtacagtattgagtctgatcaataaactaattgtctacaaaagaaatgcagcactgggatcataactgttgaatgaactggtcttactacatactccatgatccagaagcagctagcttaactgaaaggtagaatggcttactgaagactcagttatgatgtagttaggagacaacacttgaaaagaatgggctctattatacaggaaacgatttatgctttgaatcagaggttattatatgttgctgtccccatggccagaatacatgggtccagaaatcaagggatgaaagtaggaatggctactctcacaattccaagtaatatctcactcacagaaattctgcttcttatcctggcaactttgagctatactggtttagagaccttagtctccaagggggggatgttcccaccaatgaacacaatggttccactaaactgaaatatgaaactacaacttagaaattttgagtgctttatgctactgaaccaatagctgtattgtatatattgtgcttttatctattctacacagtccttctatctgacagtccccctctaaaatttctgatatctctccattcttcaaacacagctcagatcactaagcttccactaagctcccaagttcctggggatctctcccttctataataaatgattttatactttataatgtttttcctaatgttggattatcacttaattattatgttttcaatgtttagattttatatcccccagctgattgtagggtcatttgaagccagaactgtgtctttgtacttctgtatatatcccgtggtagtgtttctcaagtgctggtgccagtccatgaacaatgctgtcatctgtttagggcaaaagggaaaaaataaagatatgcagccaggttttttttaaaaaagctaatatgttctagttagaagagtgtcctttgtcttgaaattgtgcccttcatactttaaaaaaaataattttgggccaggcgcagtggcttgtgccttgtaatcccaacactttgggaggccaaggtgggtggatcacctgaggtcaggagttcgagaccagcctggctaacatggtgaaatcatgtctctactaaaaatacatacacgcacacaaagtagccaggcgtggtggcgcatgcctgtaaccctagctactcaggaggctgaggccagagaatcgcttgaacctgggaggcggaggttgcagtgagctgagattttgccattgtgctgcagcctgggcaacaagagcgaaactccatataaaaaaataataatttcaactttcattttagattcagggggtccatgtgcatatttgttgtgtgggtatgttgtgtgatgctgaggtttggcgtgtgattaattccatcacccaggtagtaagcacagggcccaatatttgctttttcaacccttgtctcccatccatccctccctattctattagtccccagtatttattgttgccatctttatgtccatgagtcaatgtttagctctcacttacaagtgagagcatgtgatatttggtattctgttcctgtattaatttgcttaggataatggcctccagctgcattcatgttgctgcaaaggacatgatttcattctattttatggctgcgaagaattccatggtgtatatgtatgacattttctttgtccagtccactgttggtgggcatctaggttgaatccatgtctttgctattgtgactagttctgcagtgaacgtacgagtgcatgtgactttttggtagaacaatttattgtcttttggatatatacccagtaatggtattgctaggtcaaatggtagttctgtttttagttctttgagaaatctccaaactgttttccacaggggcttaattaatttacattgccaccaacagtgtataaatgttcccttttctccatagccttgccagcatctgttgttttgtgactttttaacgatagccattctgattggagtgagatggtatctcatttgatttgcctttctctagtgatcaatgacgttgaacatttttttcatatgtttgttggctgcttggatgtcttcttttgagcagtgtctgttcatgtcttttgcctgctttttaatggggttgttttctgcttattgaattgttcaagttccttatagacttgggatattaaacctttgtcagatgcatagtttgcagatattttttcattctataggctgtctgtttactcatatgatagtttcttttgctgtgcagaagctctttagtttaattaggttccatttgtcaattttttttgttgtttttgcaattgcttttggggatttagtcataaattctttcccaaggccaatgtctggaatggtgtttcttaggttttcttctgggattcttatattttgacgtcttacatttaaatatttaatccatcttgagttaatttttttatatggtgaaaggcaggggtcaagtttcattcttctgcgtaaggctaaccagctattccagcaccatttattaaatagagtcatttccctattgcttatttttgttgactttgttgaagatcagatggctgtaggtgcacagctttatttctgggttctcttttctgttccattggtctatatgtctgtttttgtaccagtaccatgctattttggtttctgtagccttagtatagtttgaagttgggtaatgtaatgcctctggcttttttttttttcctgaggattgccttggctattcaggctcttttttggttccatataaattttagaatagcgttttttaattctgtgaaaaatgacattggtactttgataggaatagcattgaatctgtagattgctttgggcagtatgaccaccttaacaatattgattcttccaatccacgagcatggaacgtttttccatttgtttttgtcatctatgatttgtttcagcagtcttttaaaattctccttgtaaagatctttcacctccttggatagatgcattcctaggtatttaatttatttttgtggctattatacattggattgtattcttgatttggctgtcagcttaaaagttagtggtgtgtggaaatgctactgatttttgtacattaattttgtatcctgacactttactgaagttatttatcagttccaggagcctttcggcagagtctttagggttctttaggtgtagaatcatgtaatcagtgaagagagatagtttgatttcttgttttcctatttgtatccctttttgcagtctattgattttatttatgctttcaaagagccaacatttgtttctttgactctatttatggatttgggggacttgatttcattcagctctgctctgattttggttatttcttttcttctgctaggtttggggtatgttcttatttctctagttcctttaggtgtgatgtcagaacattattctgggatctatttaactttttgaagtagatgtttagtgctataagctttcctcttaacactgcttttgttgcattccagagattttggtatgttgtttctctggtttcatttatttcatataattttttatttctgccttaattttgctgtttatccaaaagtcattcaggagcaagttgtttaatttccatgtaactgtgtgtttttaagagatcttcttggtgttcatttctatttttattccactgtggcctgagaatatgtttggtatgacttcatttttttttctgagtttattgagacctgctttatggctgagcatgtggtcgatcttggaatatattctgggtgcagatgagaagaatgtatattttgtgtttgataggtggagtattctgtagatgtctattaggtccaattggtcaagtgtcaaatttaatttcagaatttctttgttagttttctgccttgataatttttctaacattttcagtggggtgttgaagtcacccattattattgtgtggctgtcaaaatctttttgtaggtttagaagtacttattttatgaacccaagtatgccaatgttgggtgcgcatatatttggatagttaagtcttcttgttaaatataatcctttattattatgtaatgcctttctttgtccttttttactattgctggtttaaagtctgctttaactgatacaataataaggacacttgttcttttcgttttccatttgcaagatagactttcctccaaatctttaccctgatcctatgggtgtaattacttgtgaggtgggtctcttgaagacagcagatgaatgggtcttattttttaaatctaacttgccactctgccttttaagtggattgtttagaccatttacattcaaagttaatatcgatatgtgaggttttgatcttattacaaagttgttagctggttgttttgtgtggttgctttatagggtctgtgggctatgtatttaagtgtgttcagcaatttttatttatattaagtgttggaacagaaatgcagatctggggctgggcacagtagctcatgtctgtaatcccagcactttgggaggctgaggcaggaggattgcttgagcccagtagttcagtaacagcatgagaaacatagtgagaccccatctctgcaaaaataaaaaaatgaggcatggtggtgcatgcctgtggtcccagctactcgggaggctgaggtgggaggatcacttgaacttggaatgtcgaggctgcagtaagctgtgatcgtgccattgctctccagcctgggtgacagagcaaaatccagtctcttaaaaaaaatgcagatctggcttaggttctgttcatataatttttaggtaaaaacagcttctctaattatttgacattatgtaattattatatgggactatttatagagcaaaatgtctaatgctatataaatgcaagtaaatatgtggcataaaaagataatcattcagaaggtaacaaagagtataaatttctgcatttttaataaaacttctgtttatttgttaatttaatattgcccattatttaaatagccctgagggaagtttctcttgaaattttatgttgggaaaaaatttatgtgttccaaagaataaattgcattatttatcagataatgcaaaccatataattataatgtttctcttttagccttggctaccaagaagttcaatggtcaacaaaactctcaattgcattaccctatcttctcattggttgctgatataaatctctccctctctcctgggttattattctcttttaaatgttaaagaatagtgtttacatatatgggtttgtaaggtaatttgtctcaattacttatggaaagtaggaaaaataaaaataataaatgcattaccaataagtagatctccacaccggagagaagactgggagcttacacagaacgcaagcatgatatatattttgctacccgcactggaggtagtttaccatcctaatccttgtgatttttgactattttcattttttcttcagaccagtaaacattgacccaatttgtacttgtttaccatcctaatccttgtgattttgactattttcatttctttcttcagaccagtaaacattgacccagttttctcagaacaaatagacggtgagttcatgggacccacagtcattgttgggtcattttatgtttggatagacaaggctctcagcctcggatggcggcagaggttcatcccagctttgaatcttattgtcaagggacttctctttttcaacaggaagctactgttcaaatttgacaaccatcagcaactaccttgttaccacaattcttgtatgatatcagactgtgtcataatttcttgccttattattttaactattctgaacaagtggatttttctgaatttaaacatattcactagacaatactaaacttgtatagaagaggggtttattttgtttttagctttcaccaaccaaaaataagcattgatttctgttttgttttgttttttaatttttaccaaccaagaggaagcactgatagaggaagaggtttaaattgtagatttgctgaaaatattacgctaaacattgggtgagaaaatgagtgggttcaaagtttggctctgttatctcttagctgtgttattacctgtacaaattatttattttcctcttggttctgtttcttcacttataaaataagcaacaatttattattggtgtggagaataaatgacacatatagcagtgtacgtaacatattgcatataaatgatatgtatagtatatgtaaagtattgtgtgtaaatgatatatggtattgtatgtaaagcacttaggatggtcctaggcaagagttagctattattaacattttagaattatagaaatgtaattatatataataagcattacaagtgaataatttaaaaatttgcttcctaaatataagttaaatgtaatttcacataaagggtagtaggtgagataaaaaaatgtaaaaaccttctaaccacaaaagattgttcttcattatttaaatggtttcacacttccttgtggtcaatggaattatatccactcatttttgtgtcaccgacttgacctgagcatttattaaatagaagatgttcaataaatgttgacctgaaataatctgaattctaaccagctgctattcaaaggctacatttattgagatccaaggatgccccaggcactggggatacaaagataaataaaacgtggattctgcattcaagggaagcacaccctagagtgggaggcagacatgtaaagaaacaactgcatccccagggaagtggcacaagcgagaaatgtgtacagggctgggggcactgagtgggcagagaccctggggaagggtggctgtcagaggaggttttcccagtagtgtgccattgcatctttaccttccctctgctctgcgtttggggattagataaagtcagtgaatgaggcaagaaaaaaacaagcacatatagggccaaattactcttaagaaaactcttaattgctcactaagaatacatagaataaatcctatgaagatacacgtctgtacacttgtgaaatgtctctgataatgtaaagcatataagtaatattttacagtattttaattgttaaaattattatttttctgagacactattgttcaactcaatttaaaagtgtaaatgatgagcttctcctgaaaatagaagatagggcctatgttttaacaatattggctaatgaaaagacattgtactactattacatttatgactagtttgtgaatgtttcaatagagaaataaagcacactggggaaagaaaagacatatctaattttaaaaatgaaatgcattattgtaaaatagttatgaatgtgagtgaaaataaaatttactcaccaacgtgtaggctatagcctagaaatgcgtctattttttatgctatagactttctgtcatgtatccaactaaacgtctctgtccttctaagtctggaatgttatgactctgagaagacataaatatagctggcaccaacctaaaatgcaaagaccaaaacactgagataatattttatcaacaatcaaggatatttaaagtgaatgtctctgtaatgaatttagatatagaaagttctttaatggtcgttgtgaaataaaaagtaaaaagaactgatacatgtgaataacatttgaaaggcagttagcacatttccagcaggctatttttccagaaaaggggccagaaatctaaatcataagaataaaaactgctttttttttttttgtaggatgaatgttatgtagggctatgtttctgagtaaaagcctgatgctcagttctttataagaatgctctcctgaaattatataaatgcctgtacacttataaagaccttaaaataattaaaaataaattaagcagtcatcataatagttaataattttaaattacatttaatatgataaagtagcatacagtattattcaatgctctcatctttataatttataggttatactgcaataaatgtaaagttcaaagaatttttctaatttatattttgaacattttcaaatgcaaggaaaagttcaggagtagaacatttgaattgtgtagtcaccatctagataacaaactttttaaatgtgcaaagcatatatatatgagcaatgctatctcctcataaatatgcataccttttatttatagctttattgaggtataatttacatatcataaaatttacccttttaaagtgtacaattcaatgattcttggccattcataaagttgctcagtcatcatcaaaatccagttttagcacatatccattatcccccaaaattttcttgagcaattttcaatcttccctcccatcccagccttaagcaactatggatctgtgctttgtttttataaatttgcatgatctggatatttcatataaatggaatcatacaatatgtagtgttttatatcttgcttcttccatttaatgtaatattaagttttatctattaaaaacatagcatgtgtcaatatttcatttattattgctgaatagttttccattatgtggatatgtcaccttatgtttatctagtcaccagctgatggatatttagattgtttccagtttttggctattatgaacattcctgtacaagtactcatgtgggcatatatatatatacatatatatatatatatatatgtatatatatatatatatgtatatatatatatatacacatacatatatatatatatacatatttttttttttttttttgagatggagtctcttgttgctcaggctggagtgcaatggcgtgatctcggctcaccacaatctctatctcctgggttcaagtaattctgctgtgtcagcctcccgagtagttgggattgtaggagcccaccaccatgccaggctagtttttgtactttttagtagagatggggtttcacgatgtcggctaagctggtcctgaactcctgacctcaggtaatccacctgcctcggccttctaaagtgctgggattacaggtgtgagctactgcgcctggcccagcatatatatgtattttaaatttgaagttccaaagtacatgtgcaggatgtgcaggtttattacataggtaaatgtgtgccatggtgatttgttgcacctgtcaacccatcacctaggtattactagttatttgtcctgatgctctcccatcccccacacactgctgacaggccccagtgtgtgttgcttccctccctgtgtccctgtgttctcattgttcagctcccgcttataagtgagaacctgtggtgcttggttttctgttcctgcattagtttgctgaggataatggcttccacctccatccatgtccctgcaaaggacatgatctcattcctttttatggctgcatagtattccatggtgtgtatgtaccacatttttaaaaaatccagttaatcattggtgggctttgaggttgactccatgtctttgctattgtgaatagtgttgcaatgaacatacaagtgcatgtatctttataatagaattatttatattcctttgggtatatacccagtaatggaattgctgggtcaaatgatatttctggttctaaatctttgaggaatcatcacagtgtcttccacagtggttgaactaactgacattcccaccaatgctataaaagcgttcctgtttctctgcagcctcaccagcatctgtggtttcttgactttttaataatcaccattctggctggcataagatagtatctcattgtggttttgatttgcatttctctaatgatcagtgacgttgagctttttttcatatgtttcttgccacataaatgtcttcttttgagaagtgtctattcatgtcctttgcccactttttaatggtgttttctttttcttgtaaatttgtttaagttccttgtagattctggatatcagacctctgtcagatgaatagattacaaaaattttcttccattctgtaggttcactctgatgatagtttcttttgctgcgtagaagctctttagtttaattagatcccatttgtcagtttttgctttcattgcaattgctttggacatttttgtcatgaaatctttgcccatgcctatttcctgaatggcattgcctagattttcttctagggtttttatactttcgggttttatatttatgtctttaatccatcttgagttattttttatataaggtataaggaaggggtgcactttcaattttctgcatacagctagccagctctcccagaaccatttattaaataggaaatcctttccccattgcttgtttttgtcaggtttgttgaatatcagatgattgtagatgtgtggtcttatttctgagttttctattctgttccattggtctatgtgtctgtttttgtatcagtaccatgctgttttggttactgtagcctggtagtacaatgaggtgaagtaaaatgatgtctccagctttgttatttttgcttaagattgtcttggctatatgagctcttttttggttccatatgaattttaaaatagttttttttctaattctgtgaagaatgtcaatggtactttaatggaaatagcatttaatctataaatttgggcagtatggtcattttcatgatcttgattcttcctatccatgagcatggagcgtttttccatttgtttgtgtcctctcttatttccttgagcaatggtttgtagttctccttgaagaggtccttcacttcccttgttagatgtattgctgggtattttattctctttgtagcaattgtgaataaaaattcattaataatttggccctctacttatctgttgttggtgtataggaatgcttgtgatttttggttttatatctgagaacttgctgaagttgtttatcagcttaagaagcttttgggctgagatgatggggttttctagatgtaggtcatgtcatctgtaaacagagactatttgactttctctcttcttatttgaataccctttatttttttctcttgcctgattgccctggccagaacttccaatactatgttgaataggagtggtgagacagaacgttcttatcttgtgccggttttcaagggcaatgcttctagcttttgctctttcagtattacactggctgtggttttgtcaaaaatggcttttattattttgaggtatgttccttcaatacctaatttattgagagtttttaacatgaagggatgttgaattttatcgaaggacctttctgcatctattgagataatcatgtggatattgtctttagttatgcttatgtgataaattacatttgtttatttgcatatgttgaaccagccttgcatcccaggaatgaagccaacttgatcatggtggataagctttttttatgtgctggtggatttgatttgccagtattttatagaagatttttgcaccgatgttcatcagggatactggcctgaagtgttctttgttgtacctctgccaggttttggtatcaggatgatgctggtctcataaaatgagttacggaggagtctatccttttcaattgtttggaatagtttcagaggaaatggtatcagctcctctttgtacttcttatagaattcagctgtaaatccttctggtcctgggctttttcttgttggtaggctatgtattactgcctcaatttcagaactcattggtttattcagggattcagcttctttctgtttcagtcttgggagggtgtatgtgtccaggaatttatccacttctatattttctagtttatgtgcatagaggtgtttatagtattctctgatggttggttgtatttctgtggggtcagtggtgatatccttttttatcatttattattgtgttgatttgattcttctctcttttcttctttatcagtctagctagcagtctatctatttgattaattttttcaaaaaacaggttcctggatttgttgattttttttgaagggtttttcatgtctctatctccttcagttcttctctgagcttagttatttcttgtcttcctctagctttagagtttgttagttcttggttctctagttgtgatgttaggatgtcaatttgagatctttctggctttttttacatgagcatttggtgctataaattttcatcttaacactgctttagctatgtctcagagattctggtacattgtctctttgttctcattagtttcaaagaacttcttgatttctgccttaatttcattatttacccaggagtcattcaggagcagattgttcaatttccatgtagttgtgtggttttaagtgagtttcttaatcttgagttctaattttattgtgctgtggtcagagagactgttatgattttagttcttttgcatttgctgaggaatgttttacttccaattatgtgatcaattttagagtaagtgccatgtggtgctgaaaaaatatatattctgtcatttttgggtggagagttctgtagatgtctatcaggtccacttgatccagagctgagctcaagtcctgaatatctttgttaattttttgtcttaatgatctgtctaatattgacagtggggtgttaaagtctcccactattattgtgtgtgagtctgagtctctttgcaggtctctaagaacttgttttatgaatctgagtgctcctgtattggtgtatatatatttaggataataagctcttcttgttgaattgaaccctttaccattatgtaatgccctcctttgtcttttttaatctttgttggtttaaagtctgttttgtcagaaactaagatcatgacctctgcttttttctgctttccatttgcttggcaaatttccctctatctctttattttgagcctatgggtgtctttgcacataagatgggtctcttgaatacagcgcactgatgggtcttgactctttatccagcttgccattctttatcttttaattggggaatttagcccacttatatttaaggttaatatttttatgtgtgaatttgatcctgtcatcataatgctagctggttattttgcagacttgttaatgtagttgcttcatagtgtcattggtctgtgtacttgagtgtgttttgtggtggttgataatggtttttcctttccatatttagtgcttccttcaggagctcttgcaaggcaggcctggttatgacaaattccctcagcatttgcttgtctgaaaaggattttatttttccttcgcttatgaagcttagtttggccagatatgaaattctgggttggaaattcttttcttcaagaatgttgaacgttggtccccaatctcttctggcttgtagggtttctgctgagaggtctgctgttagtctgatgggcttccttttgtaggtgtcctgcctttctctctggctgcccttaacactttttccttcatttcaaccatggagaatctgataatgtgtcttggggttgatcttctcatggagtattttaccaggattctctggaattcctgaatttgaatgttagcctgtcttgctgggttggggaagttctcctggataatatcttgaagtatgtttttaaacttggttccattctccctgtctttttcaggtaccctgatcagtcataggtttggtctttttacataatctcatagttcttggaggttttgtttgttccttttcattttttttctctagtctcgtttgcctgttttatttcagaaagatagtcaagctctgagattctttcctctgtttggtctatgtggctatcaatacttgtggttgcattgtgaagttcttgtgttgtgtttttcagctccatcaggtcatttatgttcctctctaaactggttattctggttgacagctcttgtaatgttttatcatggttcttagcttctttgcattgggttaaaacatattcctttagctcagtgaagttcattattacccaccttctgaagcctacttctgtcagttcatgcatcttaacctcagcccagttctgtgcctttgttggagaggagttacgatcatttggagaagaagaggcactctggctttttgagtttttagcaattttgtgttgattttttttctcatcttcatgagcttatctaccttcgaactttgaggctgctgacctttggatggggtttttgtggggtcttttttgtttatgttgttgttgttgctgtttatctgtttttattttaacaggtaagaccctcttccatagggtttctgtggttttctgagggtccactccagaccctattcatctgggtccctcttgcactgggaggtgtcaccagtggaggctgcagaatagcaaagatgactgcttgttccttcctctgggagctctgtcccagaggggcactgacctgatgctggtggaaatgctcctgtataaggtgtctggcagtgcctgttggagggtcccacccagtcataaggcactggatccaggatctgcttaacaaagcgctctggctgccccatggtggatcggttgcgctgcactgcactggggagaaatccccctcatctggacaaatcccccttatctggactgcttggcctcttcagagccagcaggcaggaaagactaagtccactgagccacagagaccaccaccgccatgtgggcatatttaaacatttcttttagggttggggagtaaaattgctgggttgtattttaactttattgttaaacatggatttattatcttacagttgtggaagtacaaagttgaaaaatcaatctcactgggctaatgttaaggtggtggtagaactagtttcttctggaggctgtcaggagagaatctatttctccgcctagaagatgaagctgaaaatcttctagagtttacttatattccttggtttgtgtccacttctttgcatcattcccaactttggcttccattattacatctcctattactgactttgaccctcctaactttctcttctaaggaccctgtggttacagtgggcctagcaaggtaatctaggacaatcatcttcccatccccaaatcctcaattacatctacaaagttatttttatcatgttaagtaacaaatctccaggttctgcagattagatatgaacatcttttgagggccattattcagtctatcacaacaatattcagtcttccaattcataaacataggttgcatttgtatgtatttaaatcttctttaatttttctcagcaatattttttagtttacagatacaaattatgcacatatttgttaaatgtattcataattattttactctttttgaagctattataaatggaaatgatttattaatttaattttcagattgttgctagtgtatggaaatgcaattgggttttaaatattgattctgtatcctgaaaccttgctaaactaacattacttcagtaggttttttttttttttggtgtgcagatttatcagaatttaggattttctaattacagacagactcatatcatctgtggataaagagtactatttcgtcctttgcagtctgggtactgttgctatatttttcctcatttcactagctagaacctcctgtataacattaaaatggccatactgcccaaaggaatgtgcatattcaatgctattcctatcaaactactaatgacattcttctgagaattagaaaaaaatctgttttaaaattcatgcagaaccaaaaaagagcctgaatagccaaggcaatcctaagccaaaggagcaaagctggagatatcatgttacctcacttccaactatactacaaggctacagtaatcaaaacagcatgttactggtacaaaaacagacacgtagaccaatggaacagaatggagagcccagaaataatgccacacacacacagccatctaatctttgacaaagtagacaaaagcaagcagtggggaaaggactacatattcaacaaatggtgctggaataattggctagccatatgaaagatattggaattggactcctttcttacaccatacacaaaaattaactcaagaaagattaaagacctaaatataaaacttaaagctctaaaaactctggaagaaacctaggaaataccattgtagacataggaatgggcaagatttcatgaccaagatgccaaaagcaattgcaacaaaaacaaaattggcaaatggaacctaattaaagagtttctttacagcaaaataaactgtcaactgaataaacagacaacctacagaatgggagaaaatatctgcaaagtatgcatctgataaaggtctaatatctagaagattcatttaaggaacttaaatgaatttataagcaaaaatcaaacagccccattaaagagcaggcaaatgacatgaacagataattttcaaagaagacatacatgtggccaggaaacctatgaaaaatggtcaacaggactaatttttagtgaaatgcaaatcaaaaccacaatgagagaccatctcactagtcaaaatcagtattattaaaaagtcaaaaaatagcagatgctggcaagattgtggagaaaaaggaatgcttatgcactgctggtaggaattaaaattaattcagcaattgtggatatcagtgtggcaattccttaaagaaattaaaacagaacttccatttgacccagaaatttcattattgggtatatacacaaaggaatataaatcattctaccataaagacacatgcatacatgttcattgcagcactagtcataataataaagacaagaaatcaacctagatgcccaccaatggtagactggataaagaaaatgtggtacatatatgtcatggaatactatgcagccatataaaagaatgagatcatattctttgcagaaacatggatggaactggaggccattatcttaagcaaaataacacaggaacagaaaaataaatactgaatgttctcacttttaagtaggacctaacaatgaggacacatggacacaaagaggggaacaatagacactggggattacttgagggtggatgatgggaaaagggagaagattaaaaaactacctattgagcactatgcttattacctgggggacaaaataatctgtacatcaaacccccaagacatgcagtttacctatgcaacaaacgtgcacgtgtatccctgaacctaaaataaatgttaaaaataaaagatgaggggtagagcaagatgataaaataaaaggctctgccaattccccttgccccctgcaagcacaccaaataaacaactatctacatgcacaataaatcaccttgtaagaaccaaaaatcaggtgagcactcacaatacctggttttaatttcatattaccaaaagagacactgaagaggtacaaaaaacagtctgaaatcaaggacatcacccatttctcatccccttgcagtggcagcattgtgaggagggtgtttctgtgctctggggagtgtgagagccagcaactgtaagacattaaacttagtgctgcccttgttatagcaggaagcaaaaccagaccaaactcagctgatgcccacataaggagggtgcatttaaaccagccctagccagagaggaattgctcatcccagcatcagaacttaagttcctacaagccttgacaccatgggctaaagtgctctgggttatcaaataaacttaaaacatagtctaggacacaaagactacaactcctaggcagtcctaggactgaactgagcccagagacaatggactgggggagcatgtgacctactgagacaccagccagggtggctaagggagtactgacatcatccctcccctaaccctaagttgcacagctcatggctcaaaaagagaccccttcctttgcctgaggagaggagatgaaagagtggggaggactttattttacatcttggataccagttcagccacagcaggataaggcaacagtcacagtcatgagaccctttttccaggccctatctcccagacatttctagacacaccctagaccagaagggaacctgctgccttgaaggcaagaacccagtcctggcaggattaatcacctaactgaagagctcttggcctctgactaaccagcagtgatactcaagtacgatgttgagggccttggtaagacactgagacttgatgggttcaggtgagactcagcacattcccagctgtggtggctatgggtcaagattctttctgcttgagaaaagtggaggggaaagtaaataaaactttatcttgcaccttaggaaccagctcagctacagggcgatagagcaccaagtagccattagagttcttgattccaggacttggctcttgcatggaatttttggacctgccctgggccagaggggagcacagtccccgatgggtgagtcctagaccaggaggcattcatgacaagctaactgaagagcccttgggccttaagagaacattggcagttgtctggcaatattcatcgtgggcccgaggtggcagtggcctgaaggtgagacttttctgcctttggaaaggggagagaagagtgggaagaaccgtgtcttgtggtttgagtgccatctcagaagcagtacaatagaataccaggtggacttctaaggtttttgactctagcctggatggcacctctggacccacccagggcctagaggaacttgacgccctgaagggaaggagataggcctggctggctttgccacctcctgattatagagccccagggcttttagcatacataactggtagccagggagggattacagcagggcttgggtaagacccagtgctgtgttggctttatgtgtgatccagtacactcctagggatggtggctacagggggtgcttgtgtcactccaccctcagctccaggtggctcagagcagaaaaagagattccatttgtttgggaaaaagtaagagaagaaaacaaaagtctctgtctggtaattcaaagaattcttccagatcttgtataagaccatcaaggcagtacctctacaagtctgcaagaaccacagcactactgggcttggggtccaccctaaatcagatacagcttacatcctaatgcccaagtcctttcaaatatctagaaagccttcccaagaaggatgggcacaaaaaacctagactgtaaagactacaataaatacctaacacttcaatccccagacacagatgaacatctacaaagatgatccaggaaaacatgacctcattagatgaactaaataatgcaccatggatcaatcccagagaaagagagatatgtcacctttcagacagataactcaaaatagctttcttgaggaaactcaaagaaattcaagataacacagagaagggattcagaattctatcagatacacttaacaaagaaattgaaataattaaaaggaatcaaacagaaattctggagttgaaaaatgcagttggcatactgaagaatgcatcagagtcttttaatagcagaattaatcaagcagaagaaagaactagtgaacttgttgaagacaggctatttaaaaatacagagtcagaggaaacaaaagaaaaaaagaataaaaaccaatgaagcatgtctacgggatctagagaatagcttcaaaagggcaaattgaagagttattggcctttgagaggaggtagagaaagagacaagggtagaaagtttattcaaagggataataacagaacttctcaaatccagagaaagatatcagtatccaagtacaggaaggcaacagaacaccaagcagatttatcccaaagaagacaatctcaaggcatttaataatcaaactcccaaaggtcaagggtaaaggattctaaaaacaacaaatgaaaataaacaaataacaaacaatggggttccaatatgtctggcagcagactattcagtggaaaccttacaggctaggagagagtggtatgacatatttaaaatactcaaagaaaagaacttttaccctagaatagtatatctggagaaattacccttcaaaaatggagaaataaagactttcccaggcaaacaaaagctgagggatttcatcaacactagacctgtcctacaagaatgctaaaacagtacttcaatcagaaaggaaaggatgttagtgagcaataagaaatcacctgaaggtacaaatctcactggtaatcgttaagtacacagaaaaacacagagtgttataacactgcaactgtggtgtataaactactcttaagtagaaagatgaaatgatgaaccaataaaaataataataacaacttgtcaagacatagtacaataagaaggtataaacagtaacaacaaaaaaattaaaacgtggaagggatgaagttatggggtacagtcttcattagttttttttgcttgtttgtgcaaacggtgttaagttgttatcagcttaaaataatgggctatcagatagtatttgcaagcctcatggtaatttacctcaaaccaaaaagcatgcaatgggtacccaaaaaataaaaagcaagaaattaaatcacatctccagagaaaatcacctccactgaaaggaatataggaaggaaacaaagaaagaaggaagagaaggccacaaatcaaccagaaaataaataacaatatgacaggagtaagtctttactacaagaaacacacttcacctataaagacacacactgactgaaaataaggagatggaaaatgatattccatgccattggaagccaaaaaagagcaggagttgctgtacttatgcaaaatagatttcaagacaaaagctataagagagacaaggtcgctatagaatggtaaaggggtcaattcagcaagaatatttaacaattttaaatatatatgcacccaacactggagcacccagatacataaagcaaatattatcatagctaaagaaagagctagaccccaatacgataatagctgaagacttcaataccccactttcagcattgacagatcttccagacagaaaatcaacaaagaaacattagacttaatctgtactctagaccaaatggatctaatagttatttacagaacattttatccaagaactgcaggatggatcattctcagagagagaccatatgttaggtcacaaatcaagtctcaaaacactcacaaaattgaaatcatatcaagcatcctctgaccataatggaataaaactagaaatcagtaaccagaggaattttggaaactatacaaatacatggaaattaaatattcttctgaatgaccagtgggtaaattaaaaaattaagaaggaaattgaatttttttttaaacaaatgctaacagaaacacaacttaccaaaatctatggaatacagtggagccataagggaagtttatagctataagtgcccacatcaaaaaagaaaaacttcaaataaacaacctgatggtgtatcttaaagaactagaaaaggaaacccaaaattagtagaataaaagaaataataaagctcagagcagaaataaatgaaacagaaatgaagaaaatataaaagatcaacgaaacaaaaagttgtttttttaaaaagttaaacaaaattgacagactttagccagactaacaaaaaaagagagaagattcaaacaaataaaaccagagatgaaaaagacattaaaactgatactacagaaattcaaaggatcgttagtggctactatgagcaactacatgccaataaactggaaaatctagaaaaaatggacaaattcctggacacatacaacttaccaagattgaaccatgaagaaatccaaaacctgaacagaccaataacaagcaatgagattgaagccatgataaaaagtcttccaataaagaaaagcctgactcaatggttttactgctgaattctaccaatatttaaagaactaataccaatcctaaaactattccaaaaaatagaggaggcagagggaatacttcaaactcattctacaagaccagtattaccctgatacccaaacaagacaaagaaccagaaaaaaaaacaacaacaaaaaacaaaaaacaaacactacaggtcaatgtacctgacgaatattgatgcaaacactctcaatagaatattagaaaaacaaattcaaatttaaatgtcacttatcatgaccaagtagaatttatccctgtaaagcaaggatggttcaacgtatgcaaatcaattaatgtgatacatgatatcaacagaatgaaggacaaaaaccatatgttcatttcatttgatgaaaaggcatttggtaaaattcaacatcccttcatgataaaatctctcaaaaaactgggtatagaaggaacatatctcagcataataaaagctacatatgacagatgaacagctagtatcatattgaatggggataaactgaaagcctttcctgtaagatctagaacatgacaaggatgcccactttcatcattgttattcaacatagtactggaagtcctagctagagtgatcagataagagaaagatataaaggatatccaaattggaaaggaaaacatcaaattatccttgtttgcagatgatgtgatcttatatttggaataacctaaagactccaccacaaaatgcctagaattgataaatttaataaagttgcaggatacaaaaatcaacatacaaaggtcagtagcatgtctatatgccaactgaacaaagtgaaaaagaaaatttaaaaagtagtcccatttacagtagcgacaaatgaattaaatacgtaggaatcgacttaaccgaatgaatgaaaaatctctataatgaaaactataaatcactgaggaaaaaaattgaagaggacaccagaaaatggaaaggtattccatgttcatgcattggaacaatcactatttttaaaatgtccatactatccaaagtaatctacagatacaatgcaatttctataaaaataccaataacattcttcacagaaatagaaaaagcaaccctaaaaatcaatcccaaatttatatggaaccacaaaagacacaaaagacccagaatcgccaaagctgtcctaagcaaaaaggaaaaaactgtaggaatcccagtacttgacttcaaattatgctagaaagatatggtaatcaaaacaccatggtactggcataaaaacagacacacaatggaacagaagagagaacccagaaacaaatctacatacctacagtgaactcctttttcacaaaggtgccaagaacatacactggggaaaagatagtctcttgaataaatggtgctgggaaaactggatatccatatacagaagaataaaacaagacccctatgtcttgccatatacaaaaatcaaataaaaatggtttagacttaaatctaagaccacaaactgtgaaactagtacagggaaacattggggaaattctctaggacttcagtctgggcaaacattttttgaataatacccgataagcacaggcaaccaaagcaaaaatgaacttatgggatcacagcaagttaaaaagcttctgcaaagcaaaggaaacaataaacaaattgaagagacaacccacagaatgggagacaatatttgcaaactagccatctgacaagggaataacgagaatatgtcaggagtgcaaacagctctattggggggaaaaatctaataatccaatttaaaaatgggcaaaagattagaatggacctttctcaaaagaatacatacatatggcaaacagacatatgaaaaggtgctcaacatcattaaacatcagagaaatgaaaatcaaaactacaatgagatgtcatctcacccaagttaaaatggcttatagccaaaagacaggcaataacaaatcctggcaaggatgtggagaaaagggaaccctcatacactgttggtgcgaatgtaaattagtacagccactttggagaacagtttggagattcctcaaaaaactaaaaatagaactagcataaaatccagcaataccactgctgagtatatatcccaaagaaaggaaatcaatatattgaagctatatttgcactcccatgtttgttgtagcactcttcacaatagtaaagatttggaaaaaacctaagggtccatcaacagatgactggataaagagaatgtggtatttgtacacaatggagtattattcagccataaaatatagcgagattcagtcatttgcaacaacatggatgaaagtggagatcattatgttaggtgaaataagccaggcacaaaaagacaaacatcacgttttcactttttttttttttttttttttttttttttgagacggagtctcgctctatcgcccaggctggagtgcagtggcgtgatcttggcttactgcaagctccgcctcccaggttcatgccattctcctgcctcagcctcctgagtagctgggactacaggcgcccgccaccacgccttgctaatttttgtatttttagtagagacggggtcacttattatttgtagtatctaaaaatcaaaacaattgaacccatggatatagagagtagaaggctgattatcagaggctgggaagggtactgggggggttggatgggaggtggggatggttagtgggttaaaaaaatgaataaatgaataagtcctagtatttgataacacaacagggtgaccatggtcaataataataatttaattgtacatttaaaaataactaagagtataattggattgtttgtaatacaaaggaaaaattcttgagggtatctataatattccatctttcattatgtgactattatgcattgcatgcctgtatcaaaaaaatctcatatgccccataaatatatacacctgctgtgtacccataaaaattaaaaattaggaaaaaagaagtggcaagagctgatagtccatcattttttctttaagtagcttatagaattcatcagtgaaacaatctgagcctgggatttactttgtgggaacatttcaaaattatgaattcaatttacttagttgttagaggattattcagaattcccattgctttttgaatcgatttcagtaatttgtgtctttctaggaatttgttcctcttatttaagttgtctaatttgttagcatacaattgtcgtaatattcctttttagttttttttctctttctaagattgctagtgctgtctcctctttcattcctgattttggtaatttggtccttcctcttatcttggtcagtctaccccagtgtttgtcaatgttattaatcataaaaacaactttcaggccgggcgcagtggctcacgcctgtaatcccagcactttggaaggacaaggcaggcagataacgaggtcaaaagatccagaccatcctggctaacatggtgaaaccccgtctctactaaaaatacaaaaattagctgggcgtggtgttgcacgcctgtagtcccagctactccggaggctgaggcaggtgaatcggtcgaacccgggaggcggaggttgcagtgagccaagattgccccactgccctccagcctgggcaacagagcgagactctgtctcagaagaacaaaaacaaaacaaacaaaaaaaaacttttggttttgttttaaaattgtgttttgtcttttgattttctacttcatttatttttattctattacttatcctttacttctgcttgttttgggtttattgtgctctttattttacatttttaggttgaaacttaagttgttgatttgagatctttcttctttctgacataggtgcttaaaacagtaacttctctctgatagttgcattcactaattatacattatagtaagcattatgcaacccataaattttgaaaaaaattgttttcattaattcaatgtatttttgaatttttttcttgtgatttattctttgatctattagaggcttattgtttattttcaaatattctattgtgaatctaatttaatttcaaccaagatttgtgaacatactttttatgattttgatatttgtaaatgtattgagatttgttttgtggcctagcatatggtttcatatggtttatcctggaaaatcatctttgtgtgcttggaaagaatttgccttctgcagtcacaagacggaatattctataaatgttagttaggtcaatttgattaatgatgttgtgcaagtcttttatgtccttgttaaatttctgtctagctgttctttccattttttgagaatgggatattatttttgtctatttctcttttcagttctgctcatttttttacttaacgtattttgaatctttgttgttagtcgtgtatatatttataattgctatatcttcctagtcgtattcatgctggtttcattatgaaatgaccctgtttgtctctagcaattgttctttttctgaagtctgtattttcttatactaatttagcaactctagctctcttttggttactctttgtatggtatatcattttccattgttttacttttaacctatttgctttttttaatgaaatatgtgtcactttcattcaaagttgaattttctttttaaaaaatctagtctgatactctctgctttttgagtgggtgtttagttcatgcacaattaatgtagttatttatgtgggattttttgttgttgttgagacatggtctcactctgttacccaggctggagtgcagtggcaggaacacggctcactgcagccttgaccacctgggctcaagtgatcctctggcctcagcctcccaagtagctgggaccaaaggcatgtaccaccattcctggctaattttttattattagtggagatgaggtctccctatgttacctaggctgatctcaaactcctaggctcaagcagttctcctgcctcggactcccaagatgctaggattacaggcttgagctactgcacccagtctatttatgggacttatgtctgctatttggccttgtcttgtttcgtatcttctggcctccactatttttgacaataattcacctcttactcatattcttgttctcttgtacttgagcattcgtttttctcttgctcctttcaagattttttctttgtcctccagtagtctgactatgactacaatagttttttgtccttctgctttcccttcactaacttttacaggttgcataaatgtttttggtgtaacattttaattcctttgttgatttttaaaaattataatttcaaagttaattttttagtggtttctgtacatattacaatgtgtatcttaatttatgataatctatttcagaatgatactgagtcctgataattaaaaaagctgtgtccttttcctccctcttcctttgtgctatccttgtcatatgtatgacaactctatatgtcataaatccaacaacagtgtaattattataaagtcatgtcttcttaaaaagttaaaataaaaatatctttgtggatcttttgtattttcctacaaatttatcatatttagtgcttttcatttgtttgtgtgcattcaagctactgtctggtgtcacttcctttcaatctgaaggacttcctttaatatttatgtaaagtaagtctcctagcaaggaacttgcttagtctttcttcatctagggatttctacacttcatccttactttagaaggagataattttaaaaaatgaaatataatcacataatataacactctgtcttgtaaaatttacaattcagtctttttttagtttattcatactgttctgcggccaccacccctatctagttttagaacatttcaccatctcacaaaagaaaccccgtacccattagtagttattcctcatttttccctccccttagtttctggaagctaccagtccactttctttctctatggatttgcctattctagacatttcatacaaatggaatcatagccttctataactagcttcttttacttagcataatgttttcaatgctcatccatgttatagcatgtaaccacagtattccattcttttgatggctgaacaatattctgttgtacagatataccacatcttgtttattgattcatttaggttatttctactttttagctattatgaataatgctgctatgaacatttatgtacaagtttttgtagggttatatgttttcatttctcttgggtatatacttaggagtagtattactgagtcatatggtaatcctgtgtttaatcttttagagaactgtcacactgttttccacagtggctgtaccattttactatcccaccagcagtgtatgtggattctagtttctaaacattctcaccagtacttgttattttccgttttgtgactatagccatcctattaggtataaagttgtgtcttgtagttttcattaatatttacatcatggataataatgttgagcatattttcctgtatttattggccatttgtatatctactttggagaaatgtctattcagatcctttgcctatttttaaattgggttattttttctttttattgttgagttgcaagagttatttatgtattctggatacaagtcctttatcagcttagatgatttccaaatattttttcccatcctctgggttgtcttttgactttcttgataatgttttttgatgtacaaaacttttaattttagtttctttttttttctgttgtttgtgcttttgctgtcatatctaagaaactaatccaaggtcagaaagacacctgtgttttttccaaagagttttatagttttggcttttgaatgatagttttgctgaatataaaatttttggttgggagttcttttctccattctttgaacatgtaattccactgccttctgacctccattatttctgacaataagttatccgttattcatattgttgttgactgaacataattcattttttcttgctgctttcaagattttttcgtctttcaataatttgactataaattgtttagatgtgaattcttcttatgttgatggtactttgggtttgtttagctttatccaatttgaagaacagaaagattgatgtttttccactggtagttttttctttctgttcttcaaatgggatacattctattgatatacctttaaattcactgtatctttctgctgctatctcacatctgcatttgaaccccctctggtgaatttgccatttcagttaataatgtgtttttcaatttcataatatccattttattcatatttgtatatgtgtgtgtgcatgtgtgtagatactatatattgcatgaaacaatatacaagattagttgttaattgaaaaaaggctaaaactatgtgtagaagatgttttactttgtgtaaaaataaggtatttttattattatttatctatacttgtgttttcatagaatgtttttggaataacaatagtttttctggaaggggcaagagaatttgggatattatctggagaaagttacattctattgtaagctcatttttactggttattttttaaaaacatatgcaaaattttcttatttggtggtaaaaactacttacagttaaagaacatatttaacaaacttgcaattttgaagactttttttttgtggtcttctttggtttggtcctagtacatagtcctgtggttgttatatatcaggattctcttggtgtatggaccaattaattttagtaactagatggggcccaaagctggcatttgaccaggtgcactaggagtcaggtccaattgtggaacctggtggctaggatggtatggtcaaaaaggatgctagagagctccaatatgtagtaacaggaaggcaggcagtaactatgggaaatataggaacatgcattgtttagagattcaggcagttactcagctttggagactcctgagatctcattccatagactgctatccagggaggggactcaaagccttggaaggagatggagttctcagtattatggtgattatgcctaattcctcacttcaaatcattccgaaggataaaggaggagttctcactctcactgggcaggtgccagcacacagatacacatttctagtgattgaggttgttgtaccagtgtatgcatgtgttaccttcttttctatttcctgctgtctgtctcaggtcgttttcctcacctctcctctcattttctgtccttcactgtacccaccttgtctcatacggctctgagaggaggttgctgatgtgtttttgtttgtgataactccctgctaaggccttgatccagaactctgtgctccaattcagttttaacagatgtagacatttgggcggtagggcctagtacaagtagtataatattaacctgtttcttatatctaataatccttgttgtatatggcagctctgttggaaacttcaagtggaagggatgattgacaatgcaggattttggcagtcctgggtcttcttgtaaaaatattcccttataccatagcaatttcatagcaagtcctaacaggggtcagagaagaatcaagtttccagagccccggtaataaagtcagtcctgtagtgctggagattagctccttaaatccctcatgtctaaattcaagattgttaagagatctgaactggtcaaagatgttggttaatggttaggtaagaagaagaagaatgattcagggcattatagaaataagcataatcattaaaaatcaagttgtttgtccctctgtgtttgaactcagaaagtctgaagaagcagtatggctttagtgggaaaggattatcaaatcaggtttaaatttctgccatgcattaaatagttgaatctaagtaaggtgtcccttcctcccttcctcccttcctccctccctccctctctcccttccttcgtcttcctcctctttctctttcttctttttctttcttttctctctttctttctttcttcttttcttttcctttctttccttccgtccttctctttctttcttcttttcttttcctttctttccttccttctctttctttctttctttctctttctctctctccttccttccttctctttctttctttctctttctctctctccttcctttctttctctttctttctttctttttctttctctctctccttccttccttctctttctttctttctttttctttctctctctccttcctttctttctctttctttctttctttctctctctctctttctctcctttcctttccttccctttccttttcctttctctttcctttttctttccttctttctctagagacagggtctcatattcagaagagaagcttcacctcctaaaaggagggattagattctactatgtgtgaattttagagacaaaactcagttttatcatgagaatttggagcctacccatagtaatggtggggaagggggataaagtatattacacagctctgaagctacaaaatggtctgactgaactccatgtacttgccgaatgccccaaatcaccaaatcatcacgtctcaatagccatcaaaatcccagtttctaaaaacaacacttattggctgctttaatgataatttgtgcaacttgtttctctagatcagcaattcttaaaaattttgaagccataaatccctttaaacaatggctgaaaactacagatttcaatttaaggtaaaaattctataaactcgtacatatgatattgttctttttcttttcttttcttttttttttttttttttttttgagacagagtctggctctgttgcccaggctggagtgcagtggcatgatcttggctcactgcaacctctttctcccaggtttaagcaattctcttgcctcagcctcctgagtagctgggatgacaggcgtcagccaccacacccagctaatttttgtttttttagtagaaatggggtttcgccatgttggccaggcatatttttcaatcaatataattcattgctctggaaatttatttcctccacaaatacagaatagagaagtgttgcccagaaaagataatatctcccattcttatttttcatctaaatataattgaatacttgctagaaaagtccaaaaattcaaacaaaattaaaagtagaatttgattctgaaggtttatggcaagataaggaggttgctgttggcctgtacaggaaattggaaattgtataatgatcttgaatatgcaaatatgcatgcctttgacccaaatacttttcaaattttcatgtcaatgtctgaaaatgtttagaaaggtctgtggcatccacatctctctttgccagacaaggacaggcttatttctagatacttgagttccctcaagattcttcaggttgaatttacactacatcatttcatttgtcctgatctctgaggtcagctttgtctgcgtctgagttattgatgatatcttagcaatggaatgaagtcttctttatctgcatttccaaattgtaagcaaataatttgagcagaggtattgttcttcaatttttgtctttaaatttctgcctacaatgaaacctctaaggctttatttattctcctcaatttacagaagcacttctagcttcagagagttagcttagttaattttgttttctatgtctaactttatcttccagaattacaaaaaaaaaaaaaaaaaaaaagctcagccaaaagtttttgccttatgtatttgtttttaactagcattcatatggtgacttgatgccttcaatggaaagtttactcttgcctatgggcaaaagtattactgagaaaaccaaatcataaatggatacctttgtgtcagattatactgaacaagctttccttttctctctcaaagaactgaaatttcctcctgatgcttcaatcaactctttcaagacttgtgttaaaaaataccagtgtacttctgcttagtagataacattttaattttgctctcatttcttcataaagtcatttgaaaatgaggtggatgaagccctgactctgacgaaattgaggacttacttttaagtagataatgacaaaacttagttcaagatggttggcagagtctctaactgaaaagcataccgatgaggacagcaatgagtcattatgacatacggagcctctttgttcatcaaagcatcaacccagatgtgttaccaagtcctgcaagggctccatctgtgagcggaatatcaagattatccttatggggaggttttcttggcaaagaaacttgtcaccattttgaagacagtgagggcctttgagatttcaaaatagggctcaagaaagaggaattcttttatgaagtacaggcctgcacccagcagctgaaaatcagttgtgaactacagtgagaaatatagtggttgcatccagttgcatattgaaaggaatgatgaacagctgccaattcttctacgaatgtgcttaaaatatgagaagaatctggggctagatcatgtcacttgaatgacacactgcttcagattcctttctctgtttcaagtcatacattcactcaatcatttccaaggcacatggattaaccaaggcttctccagttgtgcatggtaatgtgataagcaaccttatccaatacttcaaaacaaagtttaatgtttgggaaaaatgcaagagttagtagaataccaacactttctccaaaaatatcctctatctaatatacttgcagcatgtcaagtcttcctttagtattgttagggccaacagatttgattattaaagccaaatcaaagagcatattaatattatgcttcttgaatatttttcaatttaaaccagacaacacctaaacatagaaagatttctgtaattgtgaatgtggttcagtggccacaagggcatgttcaataggtaataataagacatcattacatgaattaaaatcctgaggatatacaacagtatcccatgccatctcacatttacttagaatgagataatatctcaacatatggattgacattaaaatgtatgtttattgaaggcgtgtgtgtgtgtgtgtgtgtgtgtgtgtgtgtgtgtgtacatgtgtgccaattgtggtaattcatagaattcttggaaaccatatataaggggctatgtgaagaccctctggctgaattctttacagccttcttctggttaagtcagatcagcagcaaattgtgtagttaacccattttaaattggctttccatagaactgcttttactgaatgatgatgtctccaatttatagtgaggatcattgtaagaaatagttttataaagcttgttgctatgttaactaatagatattatgaaagatgtttttattacattacacagctttctctgtctcgctctctgtctctctcatagccatgggaaaagttaatttttgtcttatgggacaccttgaaacacaaagtgagtcatgtttccttccacaagggttgctagaagatttagaaccatatttgtggttcaccaaaaatattgagtcaatatttttgaaatcttgatctaagtaagttcaagctgctattttaaagctgccagctgttttctgcttcatttttgagaaggactattttcttcattaggagaaatattttcatttgtcttttgcaaaggtaaagtcaaaaattttatttcagaatggaaaactttggacaatatgggagctaaatttctctctatattaatatgaacctttgcctttctttaggggactcatgtctgtgcagattattacgccattgtctgaaagaagggcctgagactgagggtgagggaaaagtgatgttcctccctttttattgggccccagtgagggctgggtttcttgacttccaaaagggagggaaatcagaggaagaacaattcttcggtgggaagcaagctggagactgccattagactgagtttgaggaaaaggagagacaggctgggaagagagagactatggaggtccatagtttgtatatgaaaatggtcagtgcctctagaatctgtaggctaaactatggagtttggctccatagtttagcctacagattctagaggcactgaccattttcataaccaatttaaaattttccttttctttgtggcaacttctttgtgatagttcccttacttttagtaaagtcatatacattccagaaaccgacctcaagtgtggaattccctaatgtttggagtgaaggagtatgggaatgtagtggcagtcaggacaaagctggatctgagatggccagaagtgacttgcccaaagtaagacagcaagctgaggagggaagtagcccccaagatagaactgtggcagatggaagctttctgcagagctccagaaacactcagagacaggaacctggaggaagactggattgcctgtggtcacctggaatggatatttggattcttgctttggatattaaagggaacagtgaaacacaagggctgaagtaactgggacttctaggttacaagagtgtacaactttgtggcgtacacttaatttacaccttcaaccctggttccatcttattttctcatccttattttcttattacttattcttataaatttatgtatgtgcttatttaattttttaaagatgtgaatctatgaggcttgggggtaacaccagaaagggaagatatttttggccagaactcatggccacaaaggcagcagacctgttaccaccctgtgcagaggcattttgggctcgatagatccagagtgctccagtcaagggacaacaacacctactgctcttactttttttttggaatgagcacaaaaatgcccttatcagcaagaagacttcttattgccaagctgccagaatttaggcggctgcagtttgcagcaatcctgggaaaacagctccataacacctggagactttgaggccaataggaaattgaagcccttgctgctaggggaaggattggatgcaggtttcctagtaggagtaggagtggggccagttccattggataatccaggatgagcacttggatttttaaaaaattaatcctgcttattactccataacatctttagaaattatcttaagaaagcagaatagaaataattaaaaacaaaataagaaatagcataatgatcatgacaatcttttatatggtttagattcgtgtccccacccaaatttcatgtagaattgtaattcccactgttggaggtggggcctggtgggaggtgattggatcatgggggtggatttccccctttggtgctgatagagttcttaccagatctggttgttaaaagtgtgtggcacctcctcctatctctctctttctcttgccctggccatgtaagacctgcttgtttcccctttgccttctgccatgattgtaagtttcctgaggcctccccagccatgcttcctatacagcctgtggaactggaagtcaattacatctcttttgtttataaattacccagtttcaggtatttctctatagcagtgcaagaagaaactaatataatctccttccccttctcccccagaaaacccccaattatgccacacatagaatattgtcttcaaaataattctctctagagcatgaagacaacactccataattcaaaacatgttggacttctctttggagaccaccttcaaaaccatgtaccaccacaggaaaaaactccatcattaccttattgcaattagacattctgtctcagtctgctaatctttattcctccttgtctttttttctgttgaatgcatcccctcccacctctgtcccttcctcatcttttacacaagcagtagtaatatccccagagaggtcatgctgaggctgctacttgcaaagagctagagatgctgaaacacagggctgtgaggccagacaggctgggagtcaaggaagcaatttgcagcaaccccgagaggagactgatggtggtaagttaatttgtatgcagtctgcaaagagctattttatagctgagtgctgtacgggtgaatcatggtaggttgggattgctgtggccagtcaaattgctttgaatttaggaaaacctatatagagcatcatataaatacctggtgtagtcattattacctatttagtttaaaggaaatagcaagttattttgggttacaatggaaccttgttataaagacttgaatgttaaaatgttgttggttttacatatctgaatagtaattttttcatttgcctcatagtagtaatagtagtatcagaaaatattctccccaagccaaaaatgcaacaactgaaaaacatggaagaaaaaagccagtagggggcacgctgattagaactaaatgctcttgagtcaactctatcactgttccctcctccccctaagaagtaagagttatttcaaatatgaattcaaaagtcagcatatggaatttttattttcttgtttgcttagaggatataagtatttgcaaagtagaatgagtgaattttataataaaattagcaagtaaataataatgtcttttataattaccttgatcccctcatttttaaatataaaaatgccctttctacagtccctcttaaacctggttcttaacattttccttgactatcaaaataagatattctgaaaggtagactaaaacatgaagaagtaaaaaaataacaaaataaaatgacctataagaggagttcctagagtcaaaatctacttatgttttgatttattttttccactgttttcctgtgtatttccctatgactatttaaaagtgtaaggcagtattataatgcaattacttttttaaaagagaatttatggcaatgttgtgatggcatgagaggtagcatgatatgtgttcttcttagcctggacacagcattccaatccttccaagagtaaacttacattaacacatggagaaccagggaagtaactcgggactggttggcatgcaacttttcatcatataactttcaaagttatcatctgattgggctggtgtacatcaccacacatggagcatccttagtggatgaagggatttaacctttcttatgtccacttttacataattaccattggcttggactctgacccttgggccaatatgtcatggccacggaagtggggctgctttttcttagcacatagtacagtctcagcatatgtggaatttagtttataaagtcaatgtgaaaatctaggtgagagaagttgatgtgacttaggatagtagctacagaaaaggtgaaaaaagcagttggattcttggtatacttagaagccaagctaacattatttgctaatgggatgagtgtgggaaatgaaagaaagagagaagtcagggatggcttgagcaactggcatagacaggggccatttactgaaggaggctataggaggaagagattggggggattggatatgttaagtttgaaattcatcttaacgatcaaaccaaagattttcaatgtacaaatcttgacttcaaaggagtcgcaggatgtagaggtataatttgggggtcatcaaggaggtgtgttgtgtagtgcttaaaagcagctactctggagccagattgcttaggttccagtcttggctcttttctctactagctgtggccctgggcaaataatttaacttctctatgcctcccttttccttctgagttgaggatcataatagaaacaatcttagtgctgttgtgaaggatgattagtatatgtcatatacttagaactaggcacaaagtaggcatatcaaccatttgtcctattattatcacataagtatagttcatatttaaagccattatactcagtgagatcacttgagtctagcaggaaacagagttcaaagactgagacccgagatcctccaatatttagattgtaggaggaggggaagagactagacgagacttaagagtgaataggataagaagaaagagcaaatagtgtccccagaagtcaactgaaaatatctagaagaaagcagagataaaagtatcatgtgctgttgacaggttaaataagatgaagcctgagaaccatctactgacttaggctacatagagattttaggggacctttgcaagagctattctgatgggaaagtacggcacaaaaaagacataatatgtaaaggatagtgttacagacttgtatctttatacactagaattctgattattttggtaaggaacccccactatgacagcgccttagagattgagactgtccgagggcacagcaaattcacaacccttatctcacgttaacttaggggtacacacttatttagtggaatgttaggcaacattgccagtactcttttagtagttatttttctcattttattttttgctgtagacagagtcaaatttgcacatgtcaaatcatgtaataccactgtcttattacaagctaagtcaacattagacataaacaactgctaagggtggcttcctcaaaatggaacttgggaagtggttggcaattttggtttcatggactcaggagtatatttgtcccatcccctgctttcttcatacagtattaaatagtgagcatttctgcatgttattaatttttttcacaaatgtcatttttaataactttaataattcaacctatgcctattccataattcatttaactattcttttgcacattgatggtgtttataatttttaatcgtttcaaacaccaccatattaatctgtcatacattaatctttgccattctctctatttccttggggtagagggtagttctcaaaaatgggattaaagcatgaatattttagaggctgctgttaaatagctttctagaaatattataccaatacaagatatgccaacagagataaagtgcccacctcaccacaccctggccaataccgaacatgcatttttaagttgtgacagtttttctccatgaataaaggtatcatactggtgttttaattttcagtccaaaggttagcatctttatttgcttattaagcattgtatttttttccttctgaaatttttatgttccagttctttgcccttttttggtttttattactatggttctatgtcatcttgatatgtgtggatctcttccttgtgactgatagctcataaaactacttttccctccacgccccccacccactttccttagttccctgaaaagcagtaggcacaagaaatggcatggaaatcacagtcctgactttaggcaaatgttcagcgctgccactgtcagctttaactttctggggatttggtccctctgcaaaagcttcctgaggatctacaggttaaaaaaaaaaaaaaaatagagaataggtttccaccacccagtcatttactgggcaaacactttctaaagatatataaaactcaccccacaggttagagaatttagctcaatgattcaaataaaagcaagcagcaagcaacatttaaaaatgtcatcttttaatatctcctaaactgagctgtgccctgctgggtgaaaaggctactccaccaagcagccgatgcaggattccttttagagctctcagtgcctagcaatatgcaggaagactgatgaaaataattgcactgtaagagaatctgactaaacatttttttagcagaaatcccaaatacggcataattttatggacggtagccttcatgctgtgcgttagatctctatttattacaaatatttgattaaacatttgtgacttagaatatcaaatgattaaaaattacctaacacaagagttatagcaaccaggattttgtctactgccttaagaactgctagaacattaattaggaatatcatgtttgcaccaggcaaatgtctctatttcttagatattgcgatgtgccaatctaaaccattttatctatcccaatggtgactcattgaaaagatgataaacttctagtatcataattgttatgtctagactgaaattacatacaggtgcaataaatgctttcctaaattgtgtacaaatcagagtcttacaaatttaatagagataagaaatttgtattgtaagcaattaaaataaaaaccagactgtagcattttgtagggcaaataattatttcacaagtaaagaatctatacctaatttatctgcaaaccatgtgcacttgctcaagtcatttaccattttgggggctcagtctcctcatctgtaaaatgatgtttctgtacattgttttttttttttgagatggagtcttgctctgtcgcccaggctgaagtgcagtggtgctatctcggctcactgcaagctccgcctcctgggttcaagccattctcctgcctcggcctcctgagtagctgggactacaggtgcccgccaccatgcctggcgaattttttgtatttttagtagagtcggggtttcactgtgttagccaggatggtcttgatctcctgacctcgtgatccgcccaccttggcctcccaactctacactgttttagatgtatctctaaggctcctccgactctatcactgttctaatatgtaccatatatagacagaaattggccttattaaaggtctaccctgtaaaaggtgctacttattctggaaaaagtcatctcaggtctcagtctttgacccttatctcctgctagactgaagtgatctcatcgagtacaatggctttaaatatcaactatactcatgtgataataataggacgaatggttgatatgcctactttttgtgcctcattctaaatatatgacatacactaattatccctcacaacagggtcaatgcatccagtctagaaattcatctataatgatctttttacttaggattttataacaatgtgtattagtttataatagctaaaccaaaactatacaattaatttttaagaaattcagtgtttatgagccctattcctaaagaagtttgtttcctccatcacatcctacaaaatgcctgctaatcaatactgctgcttgatgattactggatgacagcgtctcattctgtgtacaccatcctggttctatatctgggttttgtgttttcactcttctgaacactgttgtatagttgaaaaaggaaactatgagcaagttctcctactctacacatttttaaatttgaaagtttttcattgtgaaatctgtattagccagacacttagttggaagtgaataaagtgcaactcttatgcttatgtatatatgtatatatattcctaaaatatattcttatatataaacatatggttcctggcttacaatggttctatttatgattttttcaaatttataatgatgcaaaagtgatatgcatttagtaaaaaccatgttttgagtatctatacaaccattgttttcactttcagtacagtattcaataaattacatgagatgttcaacactttaatataaaataggctttgtgttagatgattttgcccaacagtaggctaatgtaagtaccctgagcatgtttaaggtaggttagactaagctatgacgttcagtaggttaggggtattaaatacatttttgacttaggattttttcaacttacgatggatttattgggataaaaccacacggtaagttgaggagcatctgtattcttacagagtggacaaggttggatgggactggccatacaggaggactagaattttttcaggatgctgtctctcaattctcattccttctgcatgtcagctttatccttgtgagtgtctccatatggcagtgtatgtggccaacagtgtcgctggggacatatccttatagatcttggcaagaaaagaaaaaagttcctcaagaagaactctcactggacccgtttaactgtcatgcccttcctgacccatcactgtggccagatgcatgctaacgtgtttaggtggggaggcacttccattatagtaaggaagaacagttcttcaaaggaaggggagctatgctattactggaagaaggtaggcaggggcctgagtagagagaaacactagatgttcacatggaatcatggttgtttcaggtggatgatgatgctttaatgtatagagaacttacaacttataaaacatgttcacatacaatgtctgttggtcctcacagaaactctatgaaagttcgttcttatcctctccccattttatagatgaggaaacaagctcagagttgtgcagcttgtatgtggtgtagtggtaactaagcacttaattatgattgaggataattttttaagacttctattttaggttcaggggtacatgtacagggttggttatacaggtaaactgtgtgtcatgggggtttggtgtacagataatttcatcacccaggtagcatagtacccgataggtattatttctgtgcctctccctcctcccaccctgtactctcaattaggccccagtatgtattattcccctgtatctacccacgtgttctcattgtttcggttccatttataagtgagaacatgtggtacttggttttctgctcctgtgtcactttgctaaagatgatgtcctgcagcccatccatgttgccgtaaaggacacaatctcattcttttttatgactgcatagtattctatggtgtatttgtaccacattctcttcagccagtctaccattgatgggcatttaggttgattccatgtctttactattgtgaatagtgctgcgaggaacatatgtgtgcatgtgtcattatggtaaaatgatttatattccttttggtatagacctaataatacgattgctgggtcgaatggcaattctgttttaaattatttgagaagtcgccacactgcttttcacaatggctgaactaatttacgctcccaccagcagtgtataagcattctcttttctccacaacctctccagcatctatgattttttgactttttaatcatagcctttctgactagtgtgagatggtatttcactgtagttttgatttgcatttctctaatgattgagcatttttttataggcttattggctgtgggtatgtcttcttttgaaaagtgtctgttccacttctcaaaagaagacatttatatggcaaacaaacatatgaaaaaaagctcaacaccgctgatcattagagaaatgcaaatcaaaaccacaacgagataccatctcatgccagctagaatggcaattattaaaaagtcaagaaacaacagatgctggtaaggttgtagagaaataggaacgcttttacaccattggtgggaatgtaaattagttcactgtggaagacagtgtggtgattccttaaagatttagaaccagaaataccatttgacccagcaatcccattactgggtatatacccaaaggaatataaatcattctattataaagatgcatgcacatgtatgttcattgcagcactattcacaatagtaaagacagggaatcaaccaaaatgccaatcaatgatagactagatgaataaaatgtggtacatatacaccatggaatactatgcagccataaaaaggaatgagaccatgtcctttgcagggacatggatagagctggcagccattatactcagcaaactaacgcaggaacagaaaacaaaacaccacatgttctcacttataagtgggagctgaacgacgagaacacatggacacagggaggaaaacaacacacactagggcctgtaaggggacaggggaagggagagaatcaggaaaaatagctgatgcgtgctgcgcttaatacctaggtgatgagttgataggtgcagcaaatcactatggcacacgtttatctatatagcaaacctgcacattctgcacatgtaccctggaacttaaaatttttaaaaagtgtttgttcatgtcctttccccactttttaatggggttgccttttgcttgtaaatttgcttaagttccttgtagattctggatattagacctttgttggatgcataatttgcagatattttctcccattctgtaggtgttctgttcactctgttgatagtgtcttttgctgtacagatgaatgggcaattctcaaaagaagatatgcaaatggacaacaaacatatgaaaaaatgctcaacatcactaatgatcatggaaatgcaaatcaaaacaacaatgcaataccactttactcctgcaagaatggctgtaataaaaaaataaaaaaataatagatgtgggtatggatgcagtgaaaagggaacacttctaacactgctggtggaatgtaaactagtgcaaccactatggaaaacagtgtggagattcctcaaagaactaaaagtggaactaccatgtgagccagcaatcccattgctgggtatctacccagaggaaaagaagtcattatacgaaaaatatacttaaatatggaaccagcccaaatgcccatcaacaaatgagtggataaagaaattacatatatatgatgggacaccactcagccataaaagggaatgaattaatgactttcacaacaacctagatggaactggagactattaagtgaagtaactcaggaatggaaaaccaaacattgcatgttctcactcataagtgggagctaaggtatgaggatgcaaatggactttggggactcaggggaaagtggagtgagggacaaaagcctacaaattgggttcagtgtctacttctcgttgatgggtacaccaaaatctcacaaataaccactaaagaacttattcacgtaaccaaatagcacctgttcccccaaaacctatggaaataattggtttttaaaaagtatcctttccaaccttttagtgggctgttcacctagtcaccctgtaaacaaacaacatgcctccattatgttttaatttttctggaaaatgtttatataatagaatgatgtttcttttaagtccattcctaagtaggtgcaaatgacttgaacgatcttctcataactttcctttcattccattttccaaaatttgcccttatttcttctgcctttctctaattttctgacccttttgttcattgataaaacctaaagtgactgaagagtatgcaccaagcaacccatttttttctcctcttttatttataataaaacccccaacctcatgtgtaatgtgacttccctatttagagtgattaaatcttagtggcacattattatctgtgggcttttaacttttgattctgcagtgtttcattaaatatgccatttatttgtaggcctaagagggattctggaagagtagaaatgcaaaggacctaattccgagaaattttggtactgatcttggttttaccgctttctaatgtatgatcctaggggtgtcagggaagctgaaccactctaggtgataaagtacagaatctgctgcctcggtgtctagtcgtggcctgaagttgctatagatcaactgagaaggcagttgggaagaaatgccaaatgccctttcacatgaagggtagaatgggacaggaaaacaaggacaactggaacccatgaggacaatctggaatccacaagcacaaattggaacctggtctgtttctccctgaatctaaccctgtgacacaggtatcctgacaacctggtagccttctcctggagaatctggtggagccacacacacccctggctcacgagtcagagaagctagaggaggagagccctggccccagaccatcagtgtgagctagcacagtagagacactgaataagcaggtgcctggcaccgtgcatcaaccttcagagcaccttggctgctgcttctcttctaccacccaatctctgcacaaagttctcctgggaacatccccaacctggatttacactgggaaggatattctgggacttgtagcttcagcttagctaaacaaacatggtataaagccagtacagtgggtgtgtctataatccacctgaactccatttcctcatctgtagtgcaagtttattataggggaaaaagcatccttagcatttggttggtgttccataaattgtaattattattattattattatatagatgtagcatactcagattgactttcttgatactcatcacctgaaaggaaatacaaatttaatccttagtagttccaaaacagtccataggcctccattcatgcttagcaatcaccaaaacttcctcctgagaacgcttcttcccctattgtcttttcaggggtgagggatggggtccccattgctgcttccaaaccatttttcctcgttcctccttcaacccaggattcttaaattatgccattaacattttatcccttcttgtttctatctctaccaacttgccactcacactgaatcatgaattgatggccctggcatctgtcttactgtcagttttaccatggtggctgtcaaaatcctggatgacttccacacctatgccaatgattcattctacacttttagttttttcttttgctccacgtggaccatttacacttagggttgtactgtagatgttacttcatcaataccggttttgaaatatctatttaaagcattgttctttctaccgactatctcttatcttcctttctcagttattctggtattccaccaagcctcatcaaattgcatttctaatattttgatccatacttctctttgcacacagttcatatcttcacttaccttcttacttagtttagagtttatggaccaccaatataacctctccattacaaaccccagtaagttgcacacccgtctctttctctatcataatcgccttaaaaaatcccaacccagtttaaacctaaatatctgtttactcaatgctggcacccaagccaaatgctggagaaagagtcaataagagggaagccacagtcttctcataacctaatttcagaactgacattgtattgcttatgccatattctattagaaacaagtcaatagatgtagtaaatgatgaagggaaggaaattgcacaagggcatgaatactaggaaggcaggaccactggaggctattttagaggatgcctaccatatccaagttgccagtgatccaaatctcaccaatgtcaatgggcaattttctgccctcatcctgcttgacttctcaatgtcatttgatacaattaattacttccttattaaaatacaaggtctctggttttgtgtgtcagcatatttattggttgggtttttctcactgatgacttcttctcctttactgacctctaaatattgaaatgtctgaaggctctttccttggtcctcttatcttgatacctacattcttgtgtgatctcattccatcacatagcttttttaaaaattaatttactgttttgatacaggagtctcactatgttgccaggttggtcttgaattcctggactcaagcaatcctcccgcctcagcctcccaagtagctgggactacaggcacgtaccatcccatagcttttaatagtatctgtattctgacaaatctcacatctgtggctcctccagtacctttctcattagctacagaatcatccatccaattgctcactcgacatttttttccacttggatgtctgataagcatctcaaactttgcttatatgaaaaaaggatgattgatttctcccaagcctaccttcttctctgatcatctcctaccctaatatcccccacttgttaagtaaaacacctttgatttctcttctttgcacgtacaatgcatccagtccatctacaagtccattattctctccttccaaaatatgtgctgaatcttacctggttggcccatctccattactgtagctgtcacctggactactaaagtggcctcctgtctcttcttttcttcagtcttgtcctgttcacaccagcctctgcagagggagccacagaaaatattttagagcataggtcagagcatgtcactgtcctggttaaaacccttcaaagtcttcctattgtaatgagaattaaatctagaatcttccttcactctctaatataaaacagatatattagtctgttttgtgttgctatacaagaaactctgagactgggtaatttataaagaaagaggtttatgtggctcacagttctgcatggcaccagcatctgcttctggttagggctttaggaagcttccacttgtggtagacggtgaagggggagaaagcatgtcacattgtgagagagggaggaagaggaggcagatatgcaatgctcttttaaattaccagctctctgggcttggcatagtgactcatgcctgtaatcccagtgacttgagagactgaggtgggaagatcgcttgagaccaagagtccaaggctgcagtgagctatgatcacgccactgcactccatcctgggtgacagagcgagatcctgtctctaaaaaaaccaatacaaattaaaaataaacaatcagctcttgagagagctgaactaagagagcaagaactcactcattaccttaggatggcactaaaccatgcatgagagatcagccctcaagacccaaacacctcccattaggcctcacctccaatattggggatcaaattttaatatgagatttggagggacaaacatccaaactatataaccagataataaataagctgcctttttcaaactcatttctacatcttcaactcagctcacctcttcagattgagttccctcccttccctttttctcttcgtttgtcactctatgccaacatgggccttctttttgtccctcccttatgactaactagttgtacttcagggtctttgcacttgctttttcttccgtttagaatgtttttccctataatctttgaagagctgcctctttctcatagttcacattctactaaacaacctgctttctcagttaccttccctgaccatcccatgtaaagtagtgtctgtcccctgctctcatcccaaggcagttcctatcacatcctattttgttatttttctataatatttatcactacacaaaattactttatttcagtgttttgtgtctgttttatccctctctcccaccagaaaatgagcttctagagtttggttctttgtctctcttgttcttcacaatattcttagtgcctagagcaaagcctgatgcctcacaagtgctctataaatgtttgctgactgcctgcctgattcaaccaacaaatgtaattgaatatccactgtccacacatcctcaaaacagacccttaacttttactgttaagagtgacctaaggactagagaaatccacctaagtgattaccaaggggctaatgtccagttcgtttctaatgttcattattatccacttaattcactggatcaactgttgttttttttttcatgcctagaaaaatttttggtttgtttttgtatttacgcatggaggaactgaagcttggcgagaacaagagtgaattttggcccaaggtcacacagatggtaagtggcacatcaggggttagaacccagtctggctgtcaataaaactgtacccacccaggtgcttctccaagggctgaaaatctgcctcatttgtctaacaggctgcccaagtccccttagatcatgagagggacaagtgaccaggcaaaacaagggggaggttttgtttcctctagaggggaagaaaacatgtagcccctatctagagaaaaatcctctccatggtttccccaaacacattccaccaaagagaacttcgtctttaataatgttcccattttgctcccattttggtccagcatgtaagaaagtctctatgaatggtattttgagtggcgggcagagaagcaagtagggcagggagtattatcttagggtaggataacttgaaagatatgagattgcttttactatcatattagcttccctgcccatcatcagagtcaattctgctagccttgctctctagcaaggagcctctccattccccatcaatccatgcatttctttcccaaggctgaaccatatctggaaaacagccatgttccatatagttcctgggaaggctaggcctcaacaccacacatcttggatcagatcagtacctccctattggtgcaactgttggggaataggagtttttattctattaaagttttggagacactcatggagcaggaattttgaataggcagaaaacattattataatagtagctactgttaatactactggatatctggcattattccaggtgaattaaatgtatttattcttataattcagtcctttcaacaattataaaaatatatgttattgtcctcatttttatatataggaggaaactgagtctcagagggtttaaggttgtatttgctgaaggtctcattgttggtattagttagaattagctttgactgcaagtgacaggaacacaagattggctaaaacaaaatgtgagttgtattttcctctctcacgccacacagggttagggtcaggcttcccaattgtcaaattgcacctcatgtttctctgccatccgccacacaggggttctgtctgatggtccaagatggctgcagtgggtcaccacctactctctagtaggaggaaacaaagggagaagagaatttccacttctcttaaggacacttcttggaagtgacaaacactacttctacttgcaaccatcgatccgagctatatctcaaagacttgcccagctgcaagagagactgataaacataatctattctgggtggctacgtgtccagctaaattcaggatttatgtttttgaggaagaaggggaaaagggatgttgaaagacaattagcagtctggcacagaagggatgtggactcagggctatgtggtccagagactagaacctttccgtcatctcacactgcttcttgagcaccttggcagccaaggagaggaggcagagtgccaaagatagtttttctgtgtgtcctgaggtggcctgagggcctctgaaagtcagcctctgagacacatgctataggctgtcttagatatttcctcgattttttgctcccccagcattttgaatacgtttatatattcatccatatgttatcattgtttattttcagttttcctgaatcaaacattggcaaattggtaacattcattacatgaatgactgaattgatgaaacggccaattttgtttttttttatctctagcataatgtctagcattttacaggtattcaacaaatatatgtttattgaatggatgcctggagagccaacaactttcctaattcaattttttttctaattttgagtaagcacagcctactttctcagcatatccttttctcttccaggatgggagaagagagaaaacagaaaagacaatagaaaaagaaaaaatgggacaaggtatatttattatacaagttctctcatcccttactttcttctctccatttatttttgataccacaatcatgaattttcctatccaaatggacttccataatactctttgaggaatggcctaagaatgctaccttcaagcagcctgatgaccaccgaacttagaaatatttggagaagttgcaacaaattttattttgtcaaagcttacatgatttctctttgtgacattttcttccccgacaacctaaatgaaattgtatatttcaaagctttcaagacaaaataaaagtttgaaaatcccttgcaagttagtactggtaaattcatagttattttaactctataaagaagtaaacatcatcacattcctcatgaaaaactccagcaagagccactggcacggtttgaatataaacaaccagcactaaatgacttcatcaagctacaatccctgtgctcagcgatttagaggaaatcagcagcttaaccaaggtttattttgttttttttttttttcttttgctgagcaattgggggccaaaaataaaacactattacatcaaactgcagacaaataaaaatctgaatacatttgctgtcttctcagggcctttctgaacctaatgcacaccggagagcccaaagctgtcaagatgtttcttgccattaggcactgggggatattgtccaataagtcctgctggcattgtcagttctgagggtaaagtaggggaaagttcagaaggatgtaaatattttctaatagatgaaagtgatatctaacacattcccctgcccttttctttctttctttctttctttttttttttttttttacaaacagtaagaaacactttattataactttacaatatataaatagcttgggtcaaatctgtgctttctggcagccgggcaccaagtctgctcccctgcaggctcctgccttccttcacattgcactgttcattgggtggctctagcctggggcctggtggtcgaggctggagtcaaggggctgggcggcccagtcccaccctccatctcctcatgcggtggcctgtgcctgtcatctgcttgggttgcagctggtgtggaaggaccgctcctcaggggtcaggccagcaaagaaggggtgcagcagggcctcggccagtgtgatgcgccgggcagggtcaaattctaacatcctcctcatcaggtcaaacagctgcacgtgctccagggagtcttggagcatgtaactctgctcagggacacaaggtgcctcagtgtgacggcagggtcgtgggaagccacagcaggtccccttgcctctgggatgccttgctggactggatcgaggaggcagtgatgcctccttggaggactctacttccgccctcctggacaatgagcagctcctttcctttcatgcctgtttaacgttttgctcggaaggcaagatgaattatctgcattaattagcatgttgaaaaacttctggattgccaagtgtgttcctgtgggtggtgggaaacatgtaaataggatgtacagcaatctgttgaaaagagccaatgttttttactttgtgagtacatatgaaatgtgaaacagcttagtcaggtatgtggcactggtctttccagttaaacagatgaacatttgtctaacaacactggtgtacagtgcttgagctttgaaatgccaatttgctcaagacactaggcattgttaaaagaacactctttgggagacaagttaaatcattatcatctccagcatacataacagttattgaacactaaactaattatttcatttaattttcacagcaacccttggaggaaagtacaactggtatcatcaccatctaacagataacaaaaatggagcattggagcagttaggtaatttggccccaaaccacaaaggtactacatggtagagtcaggatttgaaccaggtcagtctgactctcagagccaatatccttcacagcattatggtgaagactttgtccatcttcttaactggatggcattacaggtgttacttagctttgctgtgcctctatttctttgtctataaaaggggaacaacattaattttatatcattgatttgtgaggattaaattatatactgaatataaaacattcagtaaaatgtcttgttatgcatgtcatgttatgattattcttttaaagtgtctaatttaagagttgggaaaaatctaattaccatccacttttctcatttggcgagtaggagttggactgagtaaatgaaatgtattgccaacagagctcacattcatggacctacactgatagaacttggaggagtccacatcaagccttcttcatagtaattgatgaagaaattggggtccaaagagtccagtcgtcattgggactatagactgggaaactgggccttggtagaactcttcaaagttgctgatgtgcctttccgtgtgagtacaatgaactcttatctacctttttgctttcattttcttgctggaatgtgtcctttgtaaacagtgaccccatattgttatcagtcaagtacatgttagttcaacatgttgtttttcatatttataaatgtgaaaaataaaatttttatcttcccaaaacttaaaaattccttgcctatgaaagtttacttttcttttagacatgtactaaaagaagcacagcttacatagaatcctttaaaagccaatttgaggaagcaaacccagagcaatcacaattatagatgtatatgtcaatatatttaaatattatttaaaacagtgtattttgtaaagatatgtatttttaccttgaaagtccatataaaacaacagttccaagttaggatgggcaacaaacatgtgtcctcattatatttgattttttaaagtttattattaaatagaaaggttctaatattcgggtctattatgttcacaacactttaaatcgttcccattttatcgtcaataaccccatgaggtaggtattatgatccttattttaaaatgaggtaactgaagatgtttggtaatttactgaacatcctacagctacaagggacaaaagggcaaaactgagactgaaatccaaatctttacgatacccaaagctcgagatttttccattgttccaggctgctttgaacagaattacgcactacagtttatttttaccacgcgtgttattccccatcccacttttccttttgctgattgtatcagccacagtccggtcagggaaagagaattacacatcttggaaatcatgactacagcagaggaattggattttacacaattgtggaagagttgagaagtaaaggcctggctggaggagggaatcagagggtcatagaataatccgtagccactttccctgaagcactagtgcctggagtgaatcagagattgtgaggggatctgagaagcctagcatgtctagctgccccctgggattgcaaagaagcagcttgtggaagggtctgtggatgctggcaccttgtggaagctgctgcccccacagctctgcagccaggtatgtgtatcatgcttaataggacaaaggccaaactcaaccactggacaaagaagactcctcatgatctcttttctgttgactttggctgcttcatcccataacactaccttaccacatttttcttcagcagtgcaaactgtactcatcttacaggttttgtgtgagaatccaatgagataaagaataggcctggcgcggtggctcacgcctgtaattccagcactttgggaggccaaggcgggtggatcacgaggtcaggagattgagaccatcctggctaacatggagaaactccatctctactaaaaatacaaaaaattagctgggcgtggtggcgggcacctgtagtcccagctactcgggaggctaaggcaggagaatggcgtgaacccaggaggtggagcttgccgtgagctgagatcgtgccactgtactccagcctgggtgacagagcaagactccatctcaaaaaaaaaaaaaaaaaaaaaaagaataggacaatgtctaggacaatgctgggcacaaaacaggtgaccaattattactcaacttctaagttataaacaagagaatctacttcagctggttgaagcatatgataagtttattccaggttattaggtggctcagaggaggccaaatcagcctggtgagcatatgaacagaaacaatatccaaactatactatgggtctgtcctagcagcaagcctgctgcagctaccactaggcacagacaccacaacaggcaccgctaatgctgctccctgactccagagttgccaccactgtcattcccagaaaccagagtcctctgtatcagcctcacatgaaaataaagttcatgctgttgtgttctcaccctgctgtcttctaagtcaaagtctcatggatgtgtctgactggtaaagcctaagtcacacacctatgctcttgccgcaagggagactgggaaagtaagagagaaaggggaaattgcccccttggaaacttgtcaaagactgactctctgcaggctgccttttagaaaatgagctgctcctttgcaactggatggaaactggctatagcccaggattaaggcactcaattctggccaacatgagtcttggatcccaggagaagggctggtacttcctgagtcttgaatgcagattgaggtgctggggctcaagccaaagtcttgctatgttatacaactataatagcaagccttggtcctcagcttcttccttataccaggagaaggccagttaccctcacatcatgaaagcttggggcagtgataatagagatgtttataagatataacaatgtcacaaagagagccaatgttctaccatgtagtattagttcattctcatgctgctaataaagaaatatccaagacttggtaatttataaagaaagaggtttaattgactcacagttcagcatggctggggaggccttaggaaacttacaatcatggcagaagagaaagtaaacatgtccttcttcacatgatggcagcaaggagaataagcaaaagggggaaaagccccttataaaaccatcagaattcactcattatcacaggaagagcattaaagtaactgcccccatgattcgattacctcccaccaggtcactcccacaacacatggggattatgggaactattaatcatcttaatacaattcaagatgagatgtgtgtggggacacagccaaaccatatcacatgttatatgactattgtaccctgaaccttcactacttgaggggaggggccattgctaatcatgtagttcataaaagtgccatggcccaaggttgcagtctgtctctaggagtctgctgtctggccctgttaagcctctgtgctctgccctagaatgcaatggattacagggccctgcacaactgctactgcttctatctttatgagctctatttatttattcatttagccagttctgatgtgtgtgataaatggcattttcactttttacccaagaacaagtaactggcttccacctttgggatgtgaatttttcactgcggaaaattacccaaatataggaaagatagtaaaaaatactgggttatcacaaagcctgacagatatctactactccaaataaatgttaatttataattaatttcccctccctcttccctactcgcctattattggtggactccattatcttggggagttgattttggcatcaggcaggcctgagtcccagttcttcttctactaaaaccatcaggccttgggaaattaacattatctcttatgagtctcagttgctcatttgtgaaataaggcatactagtaagacttattttaaaggataattgttataattaaatgaaacaaagtatgcaaataacttactactatgtcaagcacttaagaaacacctaagaaatgcaagcaattcttacaggaagacttcaaggaaagtagttctatcatgatctttattgtttagggcttgtctggtgataatctactctattctcttactaacacttaccctaaaacccagttccactgacaattttgggaaatatgctcttcatcaatggaagagtgaggaggagagaaaggaatggaaaaacacataaggctcgtggaagttcatgcccatatatcacaggtagacaacaaactcaatttaaatcacaaaagtgcaaagcagcatagtgcagagcaaaagttggccttgtggtcacaatccaatgctgaatttcagcattcttttttcctagctgtgggaccttgacactggcacttgagacccactaatttattcatttagccagtcgtgcaggcaacaaacattattgatcacctgtcatgtgccagatgtgaactggtgtgaatgatacagagaattttgtaagggagacaggcatggtggcaaatactcatgattcactatgaaagatgtgataatagagatgtttacaagatataatgatggcacaaagggagtttaagacttcctgggtgtaggggaggactcaggggatgctgtacacagtaggcagcattgcaactgggtttcaaatactgttaactaaaaaaatcatgagatctataaatctggagaagagactttatttcttataagggttacagcctgtaaatatggttctcctgcaggctgggaagtatagcctttggcaaagaccagaagacagatacttcaaaggaggtcaaaggaggaggggttggggcaggagctttatgatgaaatgggtttggctaattatacatattcagcaggttacaagaggaactataaatattcatgaaagtggtcctaaagcatgtgtattcactacacacacatgtaacatacgacccatgttcattgtgttggtggagacttaatattgtagtatctacaattaggccctagatgtcaaaggctgaagctgggacatgaagataatcaagtgtgcagactctctaaaactggccagaactagtctgtggttggtgttcttcttaacaggagaaagctactgagataagtctcttatctagccaaagctgtggttatggcttgtggaacaggcggggtgggaggggggactgaggtggtgttggtcagttagtcagtaggcaatggtggcagtgaattgaatgtgactgagctgcaattgtttgaacattgcttaccttgaggccccgtgcttgctgggctgccacagaacaagaaaaaccttgtagaagttagagcatagttcattctttaagggtagggtgcaggacttaagtaacccttgcctggcacagccttaggccctgtttataatttggtattttattgtcacaaagagtctgttccggctactttaacattaatgctggttggttgtgtctaaactgcaaaaagggaaggggtataatgagacgtgtctcacctcctgtcctgtcatggccaggaattcagtttttaaggcttctctgggttccctctggccaagatggtatgatggtgtccattcagtcagttgggaggcttgggattttatttttagtttacaagactgagtaagaattttcaaggcaggcaaatggaaaaaggacattttagacaaggagaaaagccttatgcctacaccttacaacagatgaatcctgccctgacagaaatcaaagggcctagataatcagtaatcagatatttttttaatgggtaaagcttttaacagcagaaaactccttatcctcctcctcatcatgatcatcataaacatcaataaccgaagcaccagtaagcagttaagtttaggtccacaggattagcccaggcagagtgagtgttctttgtatttaataaaggctcattctggaagaggatattgagtcatttgcctaagtctctggaattttcacacttttactaccagtatcacatatcgatgaatattattctggagacctccagaaagagccatattttcagagtgagaaggcaggaataagaggtaatcactatattacaattacattagaaaggaagaaattggttacatgaactaacacttctgagatatagtgtgagtatggttacagatataacatatttgacatagtaaaccaatgtagttttatttcctccctaaatcacgttcccttgcagtctttcaacttcatggctaagctgtgaggctcattactctaggcaaagtgaggacagatcctacctaggaaaaagagtcactgagtatcaaagtctataataagtcttaaaaatcaggctttttttttttttaataagcaggtttttcaatttctttaactcccattatcagatcgagtgccagaccttgtgagactcaattattctgagagagcgtcttggttagctcgtaacaaaataccacagactgggtggttttagcaacaaacatttatttctcccagttgtaaaggctggaagtctgagatcaggatgccagcctggttgggttgttggtgaaggccctcctcctagttcacagacagctgctttctcgttataacctcacatggcagagagaaacagagagagagagagtgagtgagctctggtcccttttcctcttcttataaggacaccaatcccatcatgcgtgcttcacattcatctagatctaattatctcccaaaggcttacctccaaataccaccacattggggattaaggctttggaatattaattctgggaaaacacaaacatgcagtccatagtagggaggcataactcaggatatggcagaaaggaaacaaaagcccatcccttctcactcaggtaggctgcagcaagaaaagagacagaggtagagctagcaggaagcactttatgatcctcagttttcccttcttaaagattccctctgatatgaaatctcagaaatatccacagagccatgagaaaatgatgggcattagagatggatggagtaagcgttaagtctgaaggagtcctacacgagacctctttaagatggtccagtatatggcaaaaaagcggtggaagggagctttagaggtcagtatgaggcttcactctatgctcctatgccttgcttaacattcaggtaacccaggtattctcccatgtccttgtgagtaggtgcacagaatgccagaactatatagaatcaaaaagcctctcatgcacaaagattttgtaactaagggaaggtggctgagaccatggatgttagcagtaagggccagtacatcacctcagcaggtctaatgggacaagtcatacctcagtggtcagcagcctagaagctaaacagctcggacatgtagcaaagacctgccaggacctgtatcctcactccttgaagtatgtgcaaggaccagcagcatcagcatcacttgatcttgttagatatgaagaatcttgggcaccatcctggaactactgaatcagaatctgcactctgacaagatgaacatttaattcatgtcacatttaagtttcagaagcagtgatctagaagagattgtatggatccaaggcctctgcctctctcctctaacccatcatgagattatacaccaaaatcaccctctgtagccatgtgctctcttagagagaagcaaaagacaggggagaaaatgtgaagaccaagaattatacagagactcagttttctaaagacatctgaatttttgaattggaccaagtttactagattggacaaaaactggtccctagagattaatcagaggtggaaagtgaaactaaattttctttgcccatttgaaaatagtagggttagactataagacctgccataaaatgatcgttgcatttggggggaaaatagagactactttcctggtttttgatgttttcattactcatgattcttctcagtcaggtaaaaatgaatgctgcatacattgtatggtttctcatttgctgtttcatattcctcacctattttatagtctcttgggcatttacattttttgactcatttcttactgaatggatccacacttctttttgcacagtaggagatgcagcttaaagctgaacttttttgcttttttctgccctgggatttaggcaagtctggacatatctacacagctggtagaggaggctggcaggactctatttacttaaaggaataaagacccatttagtaaagaattaatcttagaggaagagagtggaggtaaaggaaaaaggaaaaggatcactgggtctcaaagtataatatatagcaagtcttgaaaattagattttttgttgttgttgtaaaggagtttctaagattcttttactctcaattaatagataaagtaccaggactcttgggacttattgatgcttagagaggtgtcattcaggatctgacagggaggaaacaaaaagcccagcccttctggctcagttggttcatggacaatgaaaaagagtggggtctcactcagactgtctcttacttcatcaaggaaatgagggcccattaggcataacctccttcagctccccggtattgtccctgtaaatagctatattaatattcatccagagcaacttttctcttgtctcagaggatgcaatgttgcacattttgtcaagtatttcccttaactccatcgcttcccacctcttttttttttttttcttttgagacagagttttgctcttgttgcctaggctggagtgcaatggtgtgatctaggctcaacacaacctctgcttcctaggttcaagcaattctcctgcttcagcctcccgagtagctggggttagattacaggcatgcgctaccacacccggctaattttgtatttttagtagagacggggtttctccatgttggtcaggctgctcacgaactcccaacctcagcctcccaaagtgctgggattacaggtgtgagcaaccgagcccagcccccttcccacctctttagggacctcctattttcagagagaaaaatcttttcctctgtcctcttaggtttagttcctgaggatctgcaaattaaactaacaaaacacagattaacaggaggaaagaacataatttgtattaacacttatgtgcacaagaggtcacagaaaagaagtgaaactcaagagaatttaacatcccactgtcaacattagacagatcaacgagacagaaagttaacaacgatatccaggaattgaactcagctctgcaccaagcagacctaatagacatctacagaactctccaccccaaatcaacagaatatacattcttttcagcaccacaccacacctattccaaaactgaccacatacttggaagtaaagcactcctcagcaaatgtaaaagaactgaaattataacaaactgcctctcagaccacagtgcaatcaaactagaactcaggattaagaaactcagtcaaaaacactcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatctaaaattgacaccctaacatcacaattaaaagaactagagaagcaagagcaaacacattcaaaagctagcagaaggcaagaaataactaagatcagagcagaactgaaggaaatagagacacaaaaaacccttcaaaaaatcaatgaatccaggagctggttttttgaaaagatcaacaaaattgacagaccgctggcaacactaataaagaagaaaagagagaagaatcaaatagacgcaataaaaaatgataaaggggatatcaccaccgatcccacagaaatacaaactaccatcagagaatactataaacacctctatgcaaaaaaactagaaaatctagaagaaatggataaatccctcgacatataccctcccaagactaagccaggaagaagttgaatctctgaatagaccaataacaggctctgaaattgaggcaataattaatagcttaccaaccaaaaaaagtccaggaccagatggattcacagccgaattctaccagaggtacaaggaggagctggcaccattccttctgaaactattccaatcaacagaaaaagagggaatcctccctaactcattttatgaggccagcatcatcccgataccaaagcctggcagagacacaaccaaaaaagagaattttagaccaatatccctgatgaacatcgatgcaaaaatcctcaataaaatactggcaaactgaatccagcaacacatcaaaaagcttatccatcatgatcaagtgggcttcatccctgggatgcaaggctggttcaacatacgaaaatcaataaacgtaatccagcatataaacagaaccaatgacaaaaaccatatgattatctcaatagatgtagaaaaggcctttgacaaaattcagcaacgcttcatgctaaaaacactcaataaattaggtgttgatgggacgtatctcaaaataataagagctatctatgacaaacccacagccaatgtcatactgaatgggcaaaaactggaagcattccctttgaaaactggcacaagacagggatgccctctctcatcactcctattcaacatagtgttggaagttctagccagggcaatcaggcaggagaaggaaataaaggttattcaagtaggaaaagaggaagtcaaattgtccctgtttgcagatgacatgattgtatatctagaaaaccccatcgtctcagcccaaaatctacttaagctgataggcaacttcagcaaagtctcaggatacaaaatcaatgtgcaaaaatcaaaaatcacaagcattcgtatacaccaataacagacaaacagagagccaaatcatgagtgaactctcattcacaattgcttcaaagagaataaaatacctaggaacccaacttacaagggatttgaaggaccttttcaaggaaaactacaaaccactgctcaatgaaataaaagaggttacaaacaaagggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagtgcccgcatcacaaagtcaatcctaagccaaaagaacaaagctggaggcatcacgttacctgacttcaaactatactacaaggctacagtcaccaaaacagcatggtactggtaccaaaacagagatatagaccaatggagcagaacagagccctcagaaacaatgctgcatatctacaaccatctgatctttgacaaacctgacaaaaacaagcaatggggaaaggattccctacttaataaatggtgctgggaaaactggctagccatatatagaaagctgaaactggatcccttccttacaccttatacaaaaattaattctagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaaccaccatcagagtgaacagacaacctacagaatgagagaaaatttttgcaatctactcatctgacaaagggctaatatccagaatctacaatgaactcaaacaaatttacaagaaaaaaacaaccccatcaaaaagtgggcaaaggatatgaacagacacttttcaaaagaagacatttatgcagccaaaaaacacatgaaaaaatgcttatcatcactggccatcatagaaatgcaaatcaagaccacactgagataccatctcataccagttagaatggggatcattaacaagtcaggaaacaacaggtgctggagaggctgtggagaaataggaacacttttaaactgttggtgggactgtaaactagttcaactattgtggaagtcagtgtggcgattcctcagggatctagaagtaggaataccatgtgacccagccatcccattactaggtatatacccaaaggattataaatcatgctgctataaagacacatgcacacgtatgtttattgtggcactattcacaatagcaaagacttggaactaacccaaatgtccaacaacgatagactggattaagaaaatgtggcacatatataccatggaatactatgcagccataataaatgatgagttcacgtcctttgtaggggcacagatgaagctggaaaccgtcattctcagcaaactatcacaaggacaaaaaaccaaacgccgcatgttctcactcataggtgggaattgaacaatgagaacacatggacacaggaaggggaacatcacacacaggggcctgttgtgggggacggggagggcggagggatagcattaggagatatacctaatgtaaatgacgagttaatgggtgcagcacaccaacatggcacatgtatacatatgtaacaaacctgcacattgtgcacatgtaccctaaaacttaaagtataaaaaaaaagaagtggttagactttaggtttatatacaattttaataagggaaaaaggttttggggtttaagggactataaattatggagaaatgactaggaatatatgagggaactaatgaaacaggaatattttagaaaggtctgtttatgcaaactcatctctatgttgactttctttctctggtgattagagtcactcttttctttgtggcagggagggcatcttcacaaaggtaaatttatgccctgattttaagcacatgatacgaagacagaaaacccttcctgcatctgttgattttcaattgctttcagctcaaaaaaacggttatgccagagtggtgtatattggggtggcatgttctaatacccctcactatacggagcacaacttccctttgttatggccttattcctcccacacttgcttctttctctcttcctgcaaacatgttcaaatttttctcatgtcaatgatccttccactggcccttccatattcactcaaaataatatttattgagtgcttaccaagggcaagcattgttctagatgctgagagtattgtgagcaaataatgcagatgtaatctctgtcttcctgaaatgtatagtctagcgtcaccatactctctagctaccatccaatcttatttcctcttcatctgaacctcagagtaatccatgctgcctgatcttcctcctgtgatctcttcttaaattagtgccatcctatcatcgaagccaaaaacctaggagctcatcctagtttcatcctgctccttacccttcctatcaccaaatccagctgatatgatctaaaaattttcaaaataattccgcttctctccatctctactgccatgtttctatactggccttaatcaccttttgttcatcagtggttattataactggccttcctgcctctagttttagctccattaaatccaccttccagactgaggctatagagttcacccttatgcttataacccctcaaaaacattctcaatttcctataggataaagtgcaagttcctcagtggggcctcatatttttgtcactgccttcatctccagcctcactaactccctgtactctctctacttgcaggtctccacatatagcatgcttggtatgtgtatgtacttaaccctgtaactgcctggaacaacttttctcaggccttcttgcccactgtcacctcgctatatctaccttcagatgttcctagatttatttttcaaagctctgcttttagttacatatagtactctgaaaagccttcccagagaatccttcctggagggaagaattgttgttcttcctctatgcgtccatagtagcttttacgttattttatagctctctgttctatctttctcaccaggcagtgaggtccttttttttttcttttcttttcttttattttttattttattattattatactttaagttttagggtacatgtgcacaatgtgcaggttagttacatatgtatacatgtgccatgctggtgtgctgcacccattaacttgtcatttagcattaggtgtatctcttaaagctatccctcccccctccccccaccccacaacagtccccagagtgtgatgttccctttcctgtgtccatgtgttctcattgttcaattcccacctatgagtgagaacatgcggtgtttagttttttgtccttgcgatagtttactgagaatgatgatttccaatttcatccatgtccctacaaaggacatgaactcatcgttttttatggctgcatagtattccatggtgtctatgtgccacattttcttaatccagtctatcgttgttggacatttgggttggttccaagtctttgctatagtgaatagtgccgcaataaacatacgtgtgcatgtgtctttatagcagcatgatttatagtcctttgggtatatacccagtaatgggatgcctgggtcaaatggtatttctagttctagatccctgaggaattgccacactgtggaagtcagtgaggtcctttaaaaaagtgattggcagatggttggtgctgaactgttgtggaatcaggcatcagataagccttgatctgagccttgatcttcttccatgattgagtgagattccctgagctactgatatggcgtccagtctcaactgtggttttatcctaaagtgtcattgaatatccagcttctcttcctagcaatgagacattaatggctctatcttagctttccactcagcctgtcctatggtaggaactccacttgacctgtggttatgggagacacatctatgatgcaccatcgctatcacttgtctagatcttatctcagcacactgggttctctttccatttacactaaaatcagacatttaagggtgaacttgggggttaaacaaacatatgtggatacatttgagaaacagaccatcagcattacatgccattgagccttttagtgtctgagacctaaggttttatttgtttactcacccaatcattttatataaatgtatatttatattttaagctttcttttaaagccactgcatagcttcactatgaccagataatgagaattcttgacaatggagtgtcgtggaggtattcaaacccccggggtggggaccgaggccagcagttagatgttaggcaaactcttctgctgagacacatgcttcccctacacaaacacagatacaaatgtcagagctggaaaggagaccttagggatcatcctggtgagctatcattttagagatgcagatactgagcctattaaaattttaagtcagtgccttcagatgttatcccatggatagtgatgggtagcatttgaatgtcctggaaaaatggttacaaatagtgtatgaattccctgttcctatcccattggcagggatttaaatcaggtataggttggaaatcatcggtttcagtaatttgtcaagttattggctcacagtcaggattagaacatgggttctctgctctctacagtacaacagatggccttcctccatctatctaaccataaacaattctatcttttttctactgaatgcacgtgggaccctcacttggtcacacatttcttgctattcctcccagatttgtcctattcacaaattggataaataaatcatcttagttttcacatcgtttataaaatgttcacaaagacaaaacaacactggaacctcccagctcacattagaacctccagtggtggatactatcccatcaacctgcatccctttgggattcttcatttgcctaattgataatttttccttttgaactcaatccaacccttatttctctattttgtcccaaaatgatgttatgaaagatgtcaaatgcctggttgacatacagaaacattatatccaacttttccctcaacttacaggcttgtgaaactatcaacaaatcatttgtaaaaatttaaatgaacctgatctccatttattaatattctctccttcttcaaagcctatgactcaggtctcctggttttctttatatctctctgacaattacctctctaattcattggctatttctctatttttcttagcccagtttctatcacttctacattctcacatcattttacatactcttcccaggtcgtctcatctaaattgaagaattcaaccactatctatttgctaatgactccaagatctatgaccagtttttccaaaatataggccccatattctcatctacacctgaatgtttggctgcaggcttataccagagataccagtcatttttttgtttgccaacattcccttcttagagacgtgcccacatcccataaagagtagtcacataaatcactctgacttcatccctcaggccatagctgacttggccagagtggatatctcatccaagctagtccagtcagattcccttgtgtgggaatcaatcacctccatctgtaaggtgatttagggcttggaattgtgtcctgaggataaataagcagagaaagccagtatacagggagaatccagagattagggcagacatgcaaagggaagcaaagcaaaggacatcgtgatttcagaaagatagagatggagtaggtggctgcctgagaattttccagtgccagcaagcctatgctttattgctttcattgtatttcatgagattaaccatcctttatcaaatacaatttgaaaacctactttatgccaggaactttgctaggtataagagaaattttgttgaataaggaaaccatggtctatgactccacaaatctacatttgaatgccttctcacagtaaattcttgtttccttgcatttacttgagtgtgtttcttgcattccatcaatccatacttaattcttttttttctttttttaatttttgttttcctgggtaagcacttaattcttactgtatcccaaaccaacctcatcttcctcactatgccagctccttctccaaaaaacctacaatcttgatcagcggtggtatgcccaatcttgattaactgggtagtatgcccagttttcaaaaccagaaacctcacagttgccctttgttcctcctctgcttcactacatatctagtccgttaccaaatactttgggttctacctcaaaatgcgcttcctttcagatcttactttttgtccttacttttatcttgtccagggttagattcttgacacctgccacttgagtgtttcaaccacctcctgtcagatctacctgttgaatatctccctacacagctcatcctccatgatgtcatcagacctcttcctaggatccatactggatcttgacacatgcctcctaaacatgtccactggctttccattatcacgaaaataaaacccatacaccttatacaaaagaccctacttgatctggtccaaattcctctcaattgctctctcccacaacttgtattccagtgatttccagtcactaaacatgtagcattttctgagtttgctcatttttaataatatacatttccttctgtctaaaaaggctatcctcaggtcttggcctggcaaagtcatcttttaagaccagctcaaatatcatctattctgagccaggcagaggacatgttctcttaaggcattctgttcacccctctggcataatctagccgagagtgacaagagattacgataataatcccttatgaccttgccttgttgttaacaaagttatctcgtttgaaccatataatgactcagatgaggcaagaaggcatcccatttcatagatgagaaaatgggctcaagacagcaagtatcctccccagtgtcatgtggacaggatgggatccagattttgtagccagaatctggccacataaaagatctgagctgaggtgcttcaggagttctgcacacatttgatttgtattttattttaaaacatgtattttaataatttaaaaaaaagattgatataaaagtcaccattttagccattttaaagtgtgcaatctaatagtttttagtatattcacaatgtcgtacaactgttaccattaagtaactccagaatattcccatcactcccaaaagaaaccctatacctcccaatcccatcctctacctgcccttggcaactacttttgtcactatgaatttacctattttggatatttcacatgaatgaagttatataatatgtgacccttttttgtctggcttctttccttagcataatgttttcaagtctcatatatggtgtagcatgtatcagcgcttcgttcttttttattgcctaataatatttcattgcatgaatataccacattttgtttatccattcatcaattgatagacatttgggttgtttccactttttggctcttgtgaataatgtccctatgaacattccggtacaagcttttgtgtgaacatatattttcaattctcttgggcatatacctaggtatagaattgtagggtcatacggcaaatctttaacttttgagggattgccaaactttttccagagcactgcaccatttaataatatattcccaccagcaatatattaaaggttccaatttatccatatccttaccaacagttattttcttggcttattattatgatgatgatagtagttctagtaggtatgaagtagcatctcattgtggtttcttatttgcctttttctaattcctaatgagcatctgttcacatacttatcagccatttgcatatcttctttggagaactatctattcacattctttgtccatcttttaattgggttatttaccttattcttgagttttgtgaggttctttatatattctggatatatatgatatattatttgcacaaattttcttatattctctgggtcatcttttcccttttttgatagtttccttttatacatagaaggttttaagtccaattatttatttattgtgcttttgatgtcatattttaaaaactgttgcctaaccaaaggtcataaagctatatcacagctatattttcttctaagagttttacaggtttagcacttatattttggtaagccttagatccgttagagataatttctataaatggtgtgaggtagaggtccaaatcactctttgcatgtgaatattcaggtaacctgggatcatatattgaaaagactattctttcctcatttagtggtcttggaatccttgcaaaacatttattgaccatacatgtatggtttatttctggacactcaactctattccattggtatatatgtctatacttatgccagtaccatgtcgttttgattactacagctttgtaggaagttttgaaactgagaagtgcgagtcctccaactttgttcttatttacttcaataatttaaaagcatgtgtacatcttcttctaaaaatttttttaaagtactatgtgcttattttacacaagttaaaaatttacctaagaatttaagataaaaatgaaggcagaaggcagatattgtcaactcactgtcaacattttgaagcatttccttccacttttacaaatgtgtctgtatgtacatctaagtaaataaataatacacattttcatatttatggaaactgaaatgcatagttttatatctgcttttttccacttagcattatattgggagcaattttccagattattaaatattcctggaaaatgtcatttttacagctgcattctattatatggatgtataatagtcacttctctagagctggacacgtaggctatttctagtgtttttctggcgtaaatgttgatgtaataaacttgcttatatgtctttttgtgcatgtttaacatccttcttaggatagatgctataagtagaatcactgggtcaaaaattttaagaattttaagaatcttgatttttatggttaaattctgtaccattcctaatgagttatatgaattccaagttctttatgtataggtgcaaataacttacctgttttttttttttttttttttttgtgcctacatttaattttggtaattaaatattttgacttatggaagcttcagattttccttgaaattatatcttctaagtttttattcttattttaattttgtattttctttaactgcttttagattggaatgtccttattcacaaagggaccacagacatttatctccctctactttcaggttttgttttgttttgatctcacatagccatctgaaatttattttaatgttatttctttaggaaatatctaatttgattctttcctgaatttttagccataatattttctttgttatggtcttaaagtttatatttggtagaactgatcttgagttttctttttgtgtggtttttttttttttggcatttagtctgcacttttgcctccagataaattttattagcacattgtcaaatttttgaaaaatctcactgagatttggattgagatgacattagacctctaaattaatatgacatctttacagtattcatttacccatccaggaacatcatcaatctctctatttttatgaatcacagccaggtcttgtgattttttttcatatggatcatgcatataagcttatccctcgggttttctgtgtgtcttattaaaatcatgaatagaaaccttttgttgtttttgttgcttttctacttaaaacgtattctaacaaatacttaacaaacgtttcaatttgtatttttgtctcatatctatatcttgatagtttttcagtagatgctttggagttttaagattatgtgatattatttgcttatagttattacgttgtctcttcatttccagtaactacaaatgtggcttttctttttcaaatattagtagaatatttagaactttaacaacagtattatataagtgtggacaaagggaatacttattttgttcctttggtaatggcaatgcctgtagtgcttgttttgctattaagagaataactatctattggcttaagataaatattcttccttgtattaaggaagcatccttctattcctggtttactaaattgtttttttaaatacaaaatttgagttgaactttattacaatcttgtcattatccttcgaaataatcatatttttcttcttctaacaactgacattatgtgtgtgtgtgtgtgtgtgtgtgtgtgtgtatacatacacatatatgtatttcctaatataaaccatctttacattcctgggaactattttatttggttgtagtatagcgtttatttaagttggtgctgaattttatttgctagtatttagcacttctcattgttatattatgaaagactggcctggcatttttgttgttgttttgtgctatttgtgtcatcttttaataatgtggctattctgcctttatcaaaaaaaaaaaaaaaggaaagtattcttttgtcttctatgctttgagaatgtgtgtggtttttagattcattccgtgcaggttccccctcttgctccctagctcacatcctccactctcctttccacatctctgatttccaccacttctcccccatgtcactgtgttggagcgtggaagctctaaaggtgagatgcaggctgaggttgtctgtctgctgccactgaagagtcttgcgtgtgtttccccagactccaggagtgtatgccataaaagggtcccagtgagagtcatcttaaatgtattcaccaagagaatcatatgaatccaagacccacccacatgtggtccaagaaaagcccaaagcctgggaggcagagagtccacatgaccagccagatgctgccttgtctgcctcagaggaactgcccttaccatgtctaacaggaagaacttctaggaaaccaccaaacgcctataaaaaagggggccaaccactgtgcaaccaccacatagaaggtactgctgccagattacaatgttctgggcaagaaagataatttgggtcataaggtttcttcctctcttccccaggatctgaagataggaggtgagaaaatttaaattaaatgaaggttggagttttgatatcacactgaatgggattttaattatttaacaatttcaggagaacttttattaccagaaagtacctagaaagctatggaacctatccgagcttgcttcggggaaatgacttccgaggagagttagaagaggttgtggtgggaaagaatagtgctggctgtggcttgctcccggggggttcagcttagtaagcaaacaggcccagagatgcacttagagaacaatcaccacgagtgattccatgccttctttcacacacagttatttttagaatattcgactttattatgctttcggaggtgatggcaatgtaccagttaagctcaatcttggacattgtgatgtgcttttattgctacagtctctaattgaaataaaatggaagaacaaggaaagcatttaaagagagcaagaaaaatagctcacatgggcttgtggcaaaagaaaaaatatctagataccaacatatacttaggacaaattaaaaatacaattacacatcaaaacatacagtttgtggaaaaaacctctttttttccaaaaaagtctgtattaatttattctcacagtgctatgaagaaatacctgagactgggtaatttataaagaaaagaggtttaattgactcacagttctgcagggctggggaggcctcaggaaacttacaatcatggcagaaggggaagcaaatatgtccttcttcacatgatggcagcagggagaagtgcagggcaaaggggggcggaaagccccttataaaaccatcgtatctcatgaaaactcactagaacagcatgcaggtaaccgcccccatgattcaattacctcccaccgggtccctgccgtgacatgctgggattatgggaactacaattcaagatgagatgtgggtggggacacagccaaactatatcagagcccaatatattcaatatattggaaaaattataatggaatggaatggaatgtgacactttttactttgatctgagtattttcaatatcctatttatttgtgttattaccttttagatcagaatctaaaaataatttggggtccttgatatagtcatgcaacatttgatatatttcctttttttgaagtttctgctaagaaaatttatcaaattgattcatttaagtgcaggggcatagaaataaatgatctcctccattacccagaattgtttaaaatcatttggtagactctcaatatttcttgcagattgactttgtttatttgtttgtttttggtcaatgcagtatggcagaatgaaacggagttagtttttggacaattttcatagttgccaatgattaattcatcagtcgtgatttttcaaactattaaatacaaagtccatgtcttagactgagtcccccagatgtagaccctgagacaaggatttgagttcaagcagtttatttgggaggagatcccaggaagtactgccatggaagtgaggaagtgaaacaggggagggaagcaaaccagcattgggtacgctgagggccaacgtaccgctatgggctacctgctgggaacctctgggagcctgaaaggagcccacctgcagtgagctggtatttatctgccgtctccctgggcattggttgagagctgttagggcagggttgagtgttaactctccacgcttcccactagcctgtgtgtgacacatatctacaactagagagtcctgggcagtaagggacgacacaacagtgagttctaggaatgactgacctatacaacctacatgacgtgtatcgatcgggagccggatgtgagagacagaagactgagtgtaaaatcatacagtctaaagccaacctgggttcaaaccagatctgctcctgtttgtatgtgaccctgagcaagttatttaatctcttggcactcagttccctcatctataaaataaagataatcatattacctaccctcatagggttgttgtgaggattgagtcgatataagtaacaagtttagaataatgttgactcatggcatatactatttattcataattattatggggggggggtgttccaaagtaaatcatcaacctgccaccaacagtgcacctgtagtaaatggttaccatttacctgtcttctcctcacctttatttgataaaatttcatttaatgacctttctatagttttactatcttcactaagaatttagaacttacatggccgggcatggtggctcacacctgaaatcccagcactttgggaggccgaggtgggcggatcatgaggtcaggagatcgagaccatcctggctagcatggtaaaaccccgtctctactaaaaatacaaaaaattacccaggcatggtggcgggcgcctgtagtcccagctactcgggagggacagaatggcgtgaacccgggaggtggagcttgcagtgagccaagattgcaccactgcactgtctccagcctgggcgacagagcgagactccgtgtaaaaaaaaaaaaaaaaaaaaatttagaacttaccatgccatgtgcaatatgcaatattgaataatctcacttcaattgaaaaataaacctcatttttcatgcatacagagaaaaatgtattcatcatcattttgggggatcatttaaatccctcacctgaatgcatttcggtaaagtttagctgagggggtcttatatttgcctagagagaacacaatgtctaaccatgcatttcctcagggaactctacggtacaaggcctcttttcaccttgtaaaaagagactccaagccctgctggcaattcacaatacaaaaaggatatcttattgatatgaaagttgaatttaatgtgataggagcaaatcacttttcaaagtggccaagagagggggaaagggttaagaagtctctattgatgtaagacaaattaaaagcagaaatataagaaatgacgctccttcccaagaatcctatgagtgggtttttgtggtcttaaaatgtaccttgattcatctacttctgttcatgcatgtttgcatgtacgtccttctccaagcagctagagaaaataaagttggatgcatcagcctgttcccattgtttcaggagcaaccatccagtcttttagattctaaaagcctaaagattctgaaagtggaaaatttattgtttcactcaaaaattccataagccatcttcctaagtatgaaatagcttcagggaattctattttttctgatagtttgtcactaagtatttgagtccatgattttcaggggagccaagagatctcataccaaattgcagggaattcctatgatgttttttaaaagcagccatttagtgttcttctctgatttgcagacatgcaataaaatctttttatgcaccctatttattttcctagacatttaaattttttcatgcccagcatgctcaataattcaagcagagttgaaaatggccaggttttaccttccatgggattatccttggggactgagggtttaaaagaatgacagctatgaaaaatcccaggcctcctcccagctgtgcacattgaactgtctctactgaaagcagtaacctctgcctgcttcacaggagggattggcgagcatcctaacagtcactgtaaatcacagcccatcacacagctaactctagagcaatggggccacctagactccaaatatggaagcgctgaaaggaaaaaaatcccttctgggattcattcctagaggctccttgagatctggatattgagagggtaaaagaggagcttgtacatgtctgagtctcaggtgatcagagacaacttgaatgcatgaggatttttctccataaaacacattagatattaacttttaaatatttataaatatttacatgaaatatcttaaatattaaaaattatatttttatgagtgtgttggcctaaagatgaatatattcctgttatatattaaatattatatatttatatatataaaacatttaatttaacctaccagttttttaaaaaaaatgttaaaagaaataaagacatttagacatttttctgggaccttaaaagtattgtgggccctccacactgtgcctagtggataaattggcatggctggcacacactagggaggtcagggatttataaggcctagaagccttccatcctttagactgttagaatgttctgaaagatgtccaaggacacccaaggacttaccatactttcctgcatttcatgaatttctttcatattttaatgtttcctttaatgcatcacataatagatgacacgtttaacattgaggtggtgggactctgttcctttaaagtcttcattgaattgataatacttttaaaatatacagtatcttagaatggaggaggcatggtatccagccatgatgaggaaaagcagccacccctgcgccctgggacctttcctgacctggctctttccactccctacctacccagccacacatcaagaagcagtcctttgtcatttattagcccaccttggaagccacattgccgcagttctgctgtgctcttggttgaagcagtcacaagcccaccccactcatggaggaatgacaagttcacattgttgaagaacatatgaaatggggatatagttgttgtcacctttggagaatgtgatctgccaaacatcccccaacaaagacaaataaatagatagttggatcatttctttctttttactttttttctgttttgagacagagttgttcttgttgcccaggctggagtgcgatggcacaatcttggctcattgcaatctccgcctcccaggttcaagtgattctcctgcctcagcctcccgagtagctgggattacaggtgtgcaccaccatgtctggctaatttttgtatttttagtagagacagggtttcaccaggctggtctcgaactccttacttcaggtggtacacctgcctcggcctcccaaacggctgagattacagagagttggatcatttctaaagggaagtgggtagcaagggtgatgaacaaacagaaattacactgtgttcactccgttatgccaccgtcatgcctgtgagggagcagagcagctggctgtacaatttctttaaggaacatggatatatacccagttggttcaggcaatgggtgttactatcaaactgtttgcagaggagtaaggaaaacaaaaatgagagtagccaggatgtccttctcagtcagctgagatgtgacagcttgtttagggtggttgtgcaatttcagatgtgtcatccccagcctcagatatcagtgtttctctttgctagagctctaccattatggctgcttttgggggagtccaccaccccatttctcctgcagttaccagttaccttattccctgcttttccccttttcttgacttacaccccttgtggcttctagaatgtcatcttggtcaggtttccatcactgatctagtcagctgtgtccatcagtgggatcagtgcttccagatatctacccagcagaagccactgagggtgtggctcctcctcaagagccagtaaggaccccatgagggtgtgactcctccttaagagcaaataaggatcccatgtcttatggctcaaaataaatacttttcattgcctgcagatgttaatttcctaaggttaggcccagggtgaataaaggaggagaaaagaagactgaatctctgagggtaaaacacaggacaaagtgaaatgacttcttcaccaaagtaaccaccaaactgcctagcatcttcctgctctcctgtctctgggagagtctattgtttgccccataattactatccttcagctcatttggctcttaatcatgcctttgaatgcagcacagacagaatgaacccagctcttctgactgttctaggctcagtactcttgaaagtcaggcttcaagtagagtcaattctaaggggtctttggccccagagcagtcaatgcatcaaagtggaattttctatagcatgcttggacccttggcatccagcaccaaagtaaaacacagcttgccttacataagggagcctacattatcactcccagaataactggtgaccccacagacctgcacagatgtgctgtagaacaaacaaacatcagacgttctctataaggacaggtctaggctgcacctttatctatatccagtcaaagatatatagatttatagtgacccagaaaagaatgcagaggaacctggagaaagcaccctgctgcttagatctacaaattttgttcatctcatatatataggcacagacaaaaaggaatgttgacaggctgtatttacttgatctttttgtcatctcttagaatctaatacatgtgaaaattttggcataggtaagcacaattacttgtggtagacatatatatttgtgaagctgtaactccttgtgtatatatgttttattctttacacattagttcttgctgccaaaaagctctacattttataattcaatcagccaacacctgtaccaagatttggtcactgggaacttcaaatatttcgtatttgagaatggggaaagaaaatctgcagaaaaaaaaattgaccagaacctgcgtcatgtatttttcacaggaaagctaattattagaggaggataaaaacctgaggttccctgactagggagtggagtctagacaagggatctgatgtgacagggttccttctctatcctcttcaaaatgtaaggaatgtttggcttctggattgtgtcagaaaatagaagtaacaaatagtctttattcataaaaaactggcttttcctgacagagattttaatcgtgtgctacacacgtgaatcctttttaaagaaattgctaggggctggggaatttccaagccaacctccattaacctgcagattgagcaagacacacatctgttctttaattgcacagtatttcgaatcaaaacaaacaagcccttccacagaaaagggcctgttttcctggtgatggttttggctcgagttaccctttgtgttgagtatgtctactcttcaggccataaggtagcgatctcaccgacacctccctgtgtcacgattccccttagtagtctgtgctgcagtcactaagcatgaccactagatggcgggagaggactgagttgaggttatggcggcggctcctttctccctgcagggtgggaggaacgctgttgtctctttttcttcctgcccctttgtttgacttcaccattctctgtttccttttcgctccgctgtagttacgtgactcacctttcattcagtacctcccttcaaggaaagccctgtctcctgtccttggactgggatcacacagagttcttgggatgaccctggctctcccgcgccagccgctctgctgccaagcgcaagcattcgctcccagatgcttcgcccagttctttgcaaatgtcatccaatcagtgtccaggtgttcacggctcatcactggcttactgctctggtctacatagcttgggacattgctgtttatgcaggtataaaaaaaaaaaaagaaaaacaaaagaaagaaggaacggcagcatcacagaatgtgaatcagaatattagtctgtggtactgggagagaaaaagaagattccccagagaggatgaagaccaaacagactgcagacctgccatctctctacactgcacttggattggccatttgctgtatgcacccgggaaaaaaattcagaggaccatgctgttgtgatagctgacctaaagacattctggagagcacatgagtttgatttttacaaatgacttaataatctgggggaccaagccagggctgcagagtctggaagagcccccgccagcggtgagcagaggaggaggagacccagagtcaggggtggtagaggaacggggtttcccaggcctcttttcacagcaattagaggtctgtgttctccttgaggcaggggcgtaactcccacaagtgttaatgagatttaacgaagagaaagggagactccagagctgcatttccagtcggggcttccacagcagcagaagaggacagagttctgctgcttccagccggacctggcagagagtcctggaagcctggaccttagcatgttaccttcatcagcaattccacactccagccggcatcgtaagtccccaacctgtggtcgcctagccccttctacgaaccttgtgaagagaagctgcctgtgccttgggctagaaagttctctcgcactctatccagtgcttaagctcgcctgcctaggtttacatcccagctctgctgagtttccagctaagcctagtttcctcctccaaaaaatggagataataaatggcacctacttcacttgcggatctaatgaaagtcaagagcttagcacaatgtttgaccatataaagtacctctgagtgatgatgatgatgaatttgggcctagaattgacatcttagtcatatgaggcagaacctagttctaaggaaacacacctcagtgccatgatagaaacatttcatcatgaaaacctaagcagttgtgcaatgaaaatccctgtcatttacaacaattcccccaccccccacgtacttgggataaattagaaccaggatgggccaagtttctcgtctcgcctcctcttttcctcagtggcaaccgtgtgatttatggctctgacgggagagccaaccaaactcagttgtttcagctgattgtccccgtgagttttcaggttgatgtgaaatccaatggggtgtgaactgaaacccaagatctcctgaaagccccatgcactaagctcagtaagggaccaaaccaaaccaaaccaaagctccctccctcttgcctggcactcctggagctcacaaaaagcctgccacttgtgagcctgtgtgcctggaagggtctgctgcacctggctgggggcccctgggccattgttttcctggcagcagcaaggaggcaggtcttcggctcactcctggagctggccccacaccagcgacctcagaaaccaggcaggctttcatcctggggtctcctaggggttggttacacagagagagtgaggctttgttggaagactctcagaggcctggccaggttttcctctcacagccaagaagcaggttctagttctttccaaacccttgataccttctaaactgaaaagcggctgcccactcagaatttgggctaggccatggagatgctaaaaaccttatcttttaaaagggaattgttactgtctctctgaaaagactgcagggtttctaggagattctgaaatgatgtatacagctagagtctaaaaaggtggaaggagaggtttctgggtagggggttaaaagtgtaagctctggaggcaggcagacctgggagcaagtcccagctcatactcttcatagctgagtgaccttgagaaagtcactcaatccctctgaggttctctttgttcttttgctccctgctcactcttcatcttaccctgtctagcccaacgtttttggtagttcatgttccagtcagaagaaaagaccagtgagaactgggatttataataattacaatcatcaaaattaactgagtacagtgctcagcaatttatatcaatttcatgtaatcctgagaacccttttataaggtaggcattgcactgattcacattttaccagtgaggaaatagaagtttaggaaggttgccaaaaacttagaatgacctttctaaaatatgtctggttctattagtctttggtttaaaatcttaccatggatttatcttcaggataaaataaaattctttaacacagaaaaaaggacccttccatgctgtgagccttcaggattcagtggttaaccagtatcatctttctaacttcctgacctgcaagtctccctctgaccacactgagctttcacccttccctagctgactgaggtgttcttgcacctccaagaatctgcacacaatcttttcttcttccttcatatccttctggatctggctaactctgactatccttcaagacatggttgggtatcgctttgtctggagaataacctgtatgcccccaaagatggggataaacaccctttctagatgatctggtagtttctgagtctgcttctaacaaggttaactccaaattcctcagcccaagactgaagggaactcctttcactccttttaccctggactctcacccgtgcagctctctggcagccggaagtccaagatgcccatggactcttagcaagccattcacagtcttcatttagggaattttagtagagtctgctgaatttgtcttaaataggctgactacaatgattttttaaaatgtatacaatcatgcactgcataacaacttttcagtcaacaacagatcaaatatatgatggtgatcccaggacctgaaaatatcctattgcctggtgacattatagccatcagcatgtggtagagcaacacattactcacttgtttgccagttgtaaaaaagaatagcacatacaattacatacagtacgtaatacttgataataataaatgacgatgttactggtttgtatatttactgtactatatttttcacagttattttagggtgtactcctatttattaaaaaaaatgttaactataaaaagcctcaggcaggttcttcaggaggtgttccagaagaaggcattgttatcataggaggtgacagctccatgcatgttattttccctgaagaacttccagtgggacagatgtagaggtggaagacaattatactgatgctcctgaccctgtgtaggctaatgtacatgtttgtgtcttggtttctaacaaaaaagtctaaaaagcaaaaaatattaaaaattttaaacagaaaaaaggttatagaataacgatataaaaatattttcgtatagctatacaatatatttgtgttttaagctaagtgttattacaaaaagtcaaaattttaaaaattacagcgtttataaagtaaaaaactttatagtaacaaaggttaatttattattgaagaaaaattgtttatacatttagtgtagcctaattttacagtgtttataaagtctacagtagtatacagtaatgtcctaggtcttcacatttacttatcactcactcaccaactcacccagagcaacttccagtcctgcaagctccattcatgccccatacaggtataccatttaaaaaatcttctatagcatatatttactctagtgtttccacattgagatgtatttaaatacacaaatatttatcattgtgttacaattgcctgtagtattgagaatagtaacatggtgtacagatctgtagcctagcagcaataggctataccatacagcctaggtgtgtaggtggctacaccatctaagttcgtgtaacacaatgacaaaaccacctaaccatgcatttctcagattgtgtccccatcatgaagtgacccatgattgtacatcatatactgcccctagagtcttctcagtggccatctggctcagaagttttcaatctttcttaggacaaggactgctttcgaatttgtgggaagcaatggatgctgttggggagggggctgcacatacagacatatttactaaaggtattataatttcaggaaggttcacagatcccctgcagaccactcaggaattctgttaagaatccctgatgaagtccaactttctcatttgtagctaggaaacagggtgccagagacttgctgtaattgtccacattcagatagctagagagtgatcaagctgggatttatatccaagtgttctggttcttttagcctgtgtttattttaaagattaataatgggggaaactattaattttactgcatcccacaattggtcaagcatagattactaaacctttgtgcttccatataggattggcattagcagaattcattgacactagcaatgaccaatagtgattgaaacctccaagaaaagacattaaataatcatgataaccatagaatgttacttaaaagggtaggaagcaaaacctcattaaacaaaaattaaaaacacttaagaatgacaatatcaatagctaaaatcaacaccaacagatacaagaccatccttccagccaagtaagacaatcaaaaggtgtggaaggtcaggttgcagtcctgatcagtcaggcattcaaactggactgataattatcaaagtggaagttcacagaaagagttattataattgaggaagtaaaaaatcatgtaacttccacattcaatactgtaatttaaaaatagatttttttcacaataaccatatacaaaataatgtatttaacacataaaaccaacaagagaaaacccacaattctttctgatcacacaaaaatctatttagaatgttaaaattattattttttctctatgcctttgttgttctacttaaagtatacaaacatcatactgacatagattacttattcacttaccaaaaaggagatgtagacaatagaacatctaaattgactgaaaaatctaccaaggcttttatatttaaatcacaggcaaaatggtacatgttatcttcaaattagggtgactaaacattttggtttgcccaggactgtcccatatttggcatgggaagtcccatgtccacaacacccctcagttccaggccaaacaagacagctggtcaccctacctcaaacaacagcacaaacaaccagaataattatgttctttaaactctcaccttatatacaatttataaataataacaatgaattcattgaataaagaaataaaatattgagttggctattttacattatagactgaactgggtttttaatttaattttatttattattattattatttttagttttgagtcttactttttcctcccatgtagaaagagaattagttttgttaatttaaaaaatcatccattatgcatcagccatcatggtcaacagctgaaatttctcatgtattcgcataccacaatacggtcccattaaacatgagcgtattgaaacaaacaaatactagaataaattcatgcagtaaaactctaaaaaatagtaccgaaccataggagaaaaaggaaaccatttaaatagtcaaagttgtaagaaaaatatttttgttctgaaatggtcttggtttctttttcttaggtgagagtgtgttgggtagagatgaaagcttgggaaggatcgttaaaattccggtagatattttttaactgccactaattcactgccgaataatgttatacaaattatgtagcccaatgttgtcttacgtggagcttcttcaatatcatagtgaaatttagctggtagcaatattatgagcctgaattaataattttaggggcctgctaatgaagcagctgtagccaaaaaaaccaaggtggggaaatatctattaaaatgacatcttgcattcctttatggtttatggaagttttcaatgtatgctatgattatttccattttattgtatgggtgactcacggttatgagaatttacctaagttcacttcgtgggtatgtggaagaagagggctagaactcagaacttctgacttctagtctggtgctgtctttagttttcaactcttgccactgtgtttcagactttgcaggccactgtgagtctgacacctacaataccctctctttgaaaaaatatacatgtgcataggtcctttcctatcagttataaggcctgggacaagcgtacaaagggagagccatacaccttatgccacaggtttttcctcatctcaccccgtcctactctgtccataatactctcagattcccccgtcatcactggtttcacccttttaagtccttcaaaggaacctaaggctggaaggccaagttcaaatatagaattgttggactccttggaatttttctctggaaagtggtggccttctcatccttggccttcccagccctggggcaggaggtgggggctgcggggaggatggacttggggaagaggcttgagctctttaggtagaaaattcccaggttctaggagcagaaccatgggccaaaaaaggaggaagcaggcttatagtgggcactttgcttggacctctggaacatcatgtcctgtagagaggggcacagccagagtaaggcatgctaaggtacccctcttgcctgatctaaaagcaacggtacttgcacacatactcaaacaattctatatacaacttctgggattcacaggtgtcctgtagctcttccttagatcacaagttaagaacttctgatatcatcacttaagaatagcagtaaatcccacttgtattgctcttaataaagtataaaatgctttcacactcaaaagctcataatctcatttatttgattcttagttccattcattcattcattcattcattcatccattcaattcattcatctacttgtcaaagaacgcgccgggggtgggctatcaactgtacaggtaaaaacagatcctttcaaaagattccacagttaccacaggacccagcaatactactcctacatacatattaaaaagaaataaaacacatgtctgtttaaacacttgtacatgcatcttcgtagcagcattacttataatagccaaaaagtagaaacaacccaaatgttcatcaactgatgaatggataaacgaaatgtggtatatccatacaatgcaatattgtttcacaatacaaaggaataaagtcctggtgcatgcgaccatgggaataacctgaaaactttatcctaagtgaaagatgccaggcacaaaagccacatgtagtatgattccatttatgtgagattccccaaacaggcaaatccatagaggcagaaagtagattaatggtatgctaggggtatgcaggaaaggaataatgggggcgtgactgctaatgagcagagggctttcttttttggggtgatgaaaatgttctggacttagttgtgatggctactcaacctcctaagtatactgaaaaccactgaatagtacactttaaaagggcgaattttatagtatctgaattataccttaattttaaaacagattttcagagcaaactaaaacagatcttgttcttgcttttatgacgcctacagcctggctctctgagaggtctctgcacttattagggcagtttccaagacggggtggccgggcctcaaagcaggcccatcattttatccgtccccttcccaacaggccagtgaaggatttggcaggaagcaaacaggtggcttcatgtctcagcgtcggttttccaaagcggcctccatgggccgagacacatgccctgcaccggtgtgagagtgtatcccggacccccgcgcacccccgggctcccgcgcaccacaaggaccccaagcaaatcctggcccccattgcagctcccaggtccccgcgcacccccgttccggcccccgtgcaccgtgcgcgcccatggcggggctccggagcctcctgcgctgcctgccaggcagcgtgcacagcagaggccaaacaggcagccagcacctcctgcctcatttaagtggtaatttcctttgggggtttcattcaagtgcagccctgggaaaatcgcggcgaagagctttccgagaggaaacgttccctacgcttcccggagagttgtaaagctcgggaactttctcttttgctggtcgccagcctctacagagtaacgaaccgagcggggcgtggcggggagggcaagcgtggcgagtccgtttctgtcttctcctccagggaaaggaggagcggtgagtggtggaagagaaagattttaaattggagttttggaggcgggagagctggcaggggtctcatggccttgagatatgggcgtcttggcgcctctggaactttgttttcctcgtgggaaaggaggaatcgatttctttctgtgggggcccactaccacttatttttattttatttatttattttattttattttattttatattttggtgctgttgttggttctccctttagtcacggggcaggatgggtggaaaatatttctcaatattgtgcctgcgtttgcatcacttgggttgcttgtgaaaaatagatcccccagcttccagcctgacctactatattggaaatcgggattggggggtggggtgtgtgtgttaaagacaggggggttctagcataaaaatgtatattttttaacaactttgctggatgattgttaagcatactaaagtttaagagcctctggtaggcacaaagtccttgctgctgaagaggatctgaaagaactgaaaccaaaaaacaaaacaaataaacaaacaaaacaaaaaaaacccagcacttaagagcagcagggttgaaagggagtgggtagataatataaactaatgtcttgtttgagaaaaataaacaaaacaaagctgccacctgattcctcattcaatcaccaccctactcattcacctgtcctggggtgcaagctgagtggctgcctgattagcagcccttgtgtgtgtcctcaggacgaggcttcttgtctgtccaaagcgtggctggtgctgaatggcataggagggtaggttccttggctgccactgacgttgcctttaccagagctgtcaggaatgctcttctgccaggtcccccacgtgtctgatgtgtgtcctagtgtgaggaactcatagggaagggaaccaccaagttaaaacatggtgaggtgttcactgagatagacctgtaaacctcatcccactgactgaagtcaacccaatccattaccctgagccctcgaagcaatctccacatgagaagcaacaggagacgaggagaaaaagcttctctaaaggaaagaaggaagatttaataagtgccttaaaatatttaggaaggacaaattttgaaacttaaggctttaatcacaaagagttttgaaagaaattcacttgagtatgagggtacatgtctgcaacttgttcaagcatcagcttaagctcaaatgttaaatttaaccataaacgaggctgccaccataataaaccttagagcccaccgtgataccagaggcctacttagcctgtattaccatcctttatatttttcgggactccttaactatttactttcgtattcatcatgaagacttgctgacctcattcttcttgaatttgtgttgttagttatcttcgatttattactattattattatttgagacacagtctccttctgttcccaggctggagtagggtgacatgatcagggctcactgcagccttgacctcccaggctcaagccatcctccttcttcagcctccagagtagctgtgactacaagtgtacaccaccatgcttggctaatttttgtattttttgcagaaacgaggattcatcatgttgcccaggctgttctcaaactcgcgtgctcaagcgatccacctgcctcagcctcccaaagtgctaggattacaggcgctcagcctcttcactttgtaaaatgagacaacttacaatagtacaaacaattagaaagctggagtgggagcctctgattaacaggtttatatattatttaaagttgcaatggtatgaactgtagaagaactaaaagtaataatgcaaatataaaacatttggaggtggaggaggaaacttacattaaatgagctaaatcctccccttttcatattaaggtgtctagagatattatctcaagatgataaatggggaaaaagaggttaagcctcttatctagatttatggaggtaattgctaaaagaaccaaaaacaaacagttaaaagaggttgaatctggggagtgggatggggtggaggcagagagcagagaggtagaggctgctgcttttcagaccttaaattcttctgtcctcactcgtatgttcccacacatatgtattactttagtggattttttttaagcaaaaaccaaaaagtcaggagaaaggaaaatatggtaggaacataaaattgagtcaagaattaggcctaaaaacacataccgcattgattcacacatttgctgcagctgggccacacatttggctctgagctgtgccagagcaattatagagggacccctggtcagtccatgtataatatccacaagatgaaaacagaccaactgggagaattttggctgctccttgctattaaaatatcagaatgaaatttcttccaggggtcttcctaaagaaggcatggagagatgattaacatcctcaacaatgtctttgaaatgtacagaataatggttttcacgttttgttttttcccttagaattctcaacccagattgctggtgtcacactcaagtgcaacttagataaataattccatgagaactcagctccttgcttgatatagggatagattttggaatatcttgaaagatacatgcagttttgtactagcagaattgttacttttaactttaaaaatttcaaatagaatttctctcaactgagctattgaaaattatcagctgaaaatgagtttaaaactatactttctaatgaacacccggattacagctaatcaatgttgtctgttgaaatatatctatgtatcctaataattgagagacagatattttgtttatgatatttgtgtctatgcaaacgaagtgctattatgaacacaactatatttacatatacacatttcctgtgcttctctctggatagcaaagctgtgttctaatgctgtcttcaggatgtatatggttggggacagccttataggtgaaatgttgtatttctggtacttcagcaattagataatattgcacagaaagtcaaatataacttttacactaacaattgtggtttgcttattacaaaagcaatatgtttattaaaaatgaaaatacatgaaaagaagaaaacagaacagtataaaaacagtacagaatagaaataacaatattgcatttattaatagcattaactattagtgagtcttttctatactgtatagattaaaaatgaaataatattttatagtactcttatagactgtgatttcctttaataccagtgtctgtcttcccataccattagatattcttgcagaaaatctttttaaaagtctgtataacccatcattttggtgtatatttaggttatctagccagttgcccactgttggacattcatttcaaaaaacatgatatagaaactcaatattaaaggttgaattgataggttctttaatatactatttcccaaaagaaaagtctgagaaaactgaaagatattctaaactggatagacattttttacagccccatttaacttacatggacaatagttttaactaccatttgtcttcccaatactgtgacacttcctttcagtttgaaagagaaatttcatggtgattaatagaggtatggtttattaaaatgtttaaattaaaaagttgactatggactctggaatagtctccttctgcttcacatttctaatgttattagttaggtaagacactaacactcacctagacctataagtctccaggtctcttttcctattttaacacttcaatgactaggaaatatgacttcctctgttgttaaccctctagtgattctttaattgctccatggatccttggtgttttgtaaactgagatgactgagatgttttattgctacaatttaataatgtatatattttccaagtttccagaaaaaaagttgctagatagaattttctcattttaacattttgctccgcacattttacttaaaactttggcatccgctacagcttgtctttttgagactatgtacaaaacaaaacaaacaaacaaacaaaaaacaaagaaatcaacaaaacccaaaactaaaaatatcttacaaataggcaataaacaaatggtaatggagaatggaaaaactcataaggtatctgttgtttagtcccactaactttattttcatgtccgtaactattatggcagatcacacagataaatatgtaggtgatatctgtcttcttctagtagtcttgtttctggattctagtgtacataacagaatggaggatataagcatatcctggtgttctggaatgagtatagtgccacctaagtgtttggccctctaaacctgagaacaaagcagttaggttttgagaaatgtgtccttaggtgatttcatcattgtgtgaacatcatggagtatacttatacaaacctagatggtatagctacttacacgcctaggctatatggtatatagcctattgctcctaggctatgaatctgtacagcatgttactgtaggaatactgtaggcaattgtaacacaatgatgagtatttggattctaaacatatttaaacatagaaaaggtacagtagaaatatggcagagaagattaaaaaatggcacagctgtacagggcgcttaccacgcctggagcttgcaggactggaaggtgctctgggtgagtcagtgagtgagtagtgagtgaatgtgaaggcctaggacattactgtaaacaacggtagactttataaatactgtcaacttaggctacactaaatttgtaaaaaataaagtaattgcactatgacatttccacagctatactatcactaggggatgggaatttttcagcttcgttataatcttaggggcccactgtcctacaagtggtctgttgttgaccaaaatgtcatcatgcagcacgtgactataatgctgtaggtagaaataaactgccagcccctagtgaattacggctatgctaaaatcatgacttctgccaaatcccttctccagaaatccctggcacactcagataaaatgctccaactcacacagtgtgttttgcagtagcacatgcttccaagtttttctccaccccaggctttaacaatagcacttcaactgattgaacacttctctgtaccagctatctcacttctcacgacacccttgggggtttgaggggatgctcccattcccatcgcacccatggggaagtgaaagtgcagagtaaaaaactcatcaaaggctgcaaagctgtaagtggcaccgcttgcattgttttcctttagggtttttctctgggacactcccagctcctgtctgaacatagtagttaagaggcatctggtagctcttgaatatgggattgtggaactaataatccaaacaggggaacagaagaggcttttgccaactgttccatataagccttgccacatgacttttgtacagaatagtcagggggtacttttataaacaaggctaggtgaacatttgaagccttactgtacttcatacattggcctagaggtgggctcccttcctagcacctatttactctgtgaccttaggtaaattgtatgttcttattgagtgtcaacttcctcgtgtagaattttaggggttggactacatgagtgctcatgtctctcccaaattcaaccttttctgacactgtaaccctcacccctacccccaaccccaaaaggcttgtggaatctgttttcctactgtgctttccacacgtgtctctgtgggcttactatgtcagtgagtttatagattcagctctgaggattgctgacaaagggccatttgttgcactcacactcaaggtgagaagttacaaaaaggtgattttatatgggatgggcttctggcctacaatgcctgctcccaagggtgccctctcaatgcacagttcaaagcactgctgaatgcacatgctgatttcagtgtggctttttgtaaagccaaacgccactgacaacaaaatgggaaaggctctctcatttttattgtattcctggccattccaagagtcatttcctttcctttcagggagataaagagacatatattatgtgggcagaagatgctgtgttctggtcaataacgcaggccacagaggtcaatggctttaagccaagcctggctgaaagctgccataaatcttcaaaggttgggggaggaagatttagagactgatgtacactggctgagaggaggaaagacactggtcataaatggccctctaaaaaagaacagagtatcagtcccataaaattctacaacagtctatatggggtccctggaatggggagaattttgcccacccaagttttactatggagtagagacaaataaaaaaaatctgaaaataaatctccaaggccaacccatcccttgagactgaaacttgaagccttcttctctgattttccaattcatcagcatgtttagtgttgatgagctgactccaagcttgatgacacaaccctttatggggttccattttgtctggtcttaacttttttctctgtctttctcaaagcctactttagtaattgagttaatataaaaacatcacatattcaaactccacctccacccactaccaaaaagcacctgcttttgaaagccaccagatttatttaccagtttttgtagaggactgggagtgtgtgtgtgtgtgtgtgtgtgtgtgtgtgtgtgagagagagagagagagagaaagagagagttgtagaaacgagggtggctttacctcttctaaacacatgtgggctaaaatgcccatcaatgtagtatttgtaattccacatttactagaagcacatgacaaataactttttaataaaattactagagatattgtaaataacacgatactggattattagatgaatgtgtctgccagaccgttctgtttccattccattaaatgcatgataaacacaagaaaatactataaggaatcagtactaggaagtttaatcccacaagggatactttgtggcctgtgtatgtgcatgtatacatatgcatatttatgtatacaataaggatttccctcaaaagataaaatatgaaaatgtagggattttagacaatgaataattactttagggacttaaaaaatcttacattatgttttatttactactctgactcttcactttggttggcattttgcaagccttcacatagccctgaataattttccaagccttatgcatattttatctcattttgtcaaccctctgagaaactgaaactcagtaagagtaaatatcttgtttagtaattttcaacagcagagctggggaagaaataattctaaaccccgagaatgcatttataagtgactgcatccatgctaaacacgttgtgaacattaacttatgattctcccaataagtctcaaagattcaagtactaaagattcaagtactattatcattgccattttacagatgaggaaactgaagtttagagagggtgaataacttgtccaaggtcacatggagaatcagtgtctgattcaggacttatgtccaggtgatatcgaggtcacatttcctctaggatgaatttgaaaggaaacttcatttcaagtcacaatccaggtggtgggtacatttatactaactgcagaagaatatgggaatttcttagggaaagaaaaagacagcttaacatggtgaaacagcgcatcgcattcttaatttaacctagcgaacacaattgccatctcagatgagtatttagcagcaagaagatatttataatcagatcttcaaaagtatcctaaggccaccatttatgtctacgtggcactgtgcccaggaagatgtcatgtgcctcacaaagtccctacttactctagaagaatttagtgtaagagaaagtaaagcacattttgctgccataatgaaggcagggaagtcgtggatgtttattgtgtagcctacaggcgccgatgagccaacaaagacttgaagttgtaaacaaaattcactatctcctccactggttagatccaaagaatgaccccgaatgaacattctagagaaacctagaaatctctatcagggagtgaagtgattagagcaagaaatagatcctttcagaagctgaagaaattattgttgatctgcatgagggtcttagaatattaaaaaataagtgcttaaatgcaatattaacaattttggtatattttaaatgatgacatttacctgataatgcttttaatgcatacctctaagtgcagtgccctacaaatgtgctactcagagaataattacaggacatataaaaatattaatttataatattccattgggggaatactccattaatgggacactcatttaaagttgtatgatgaatgacttttttcactgtattaaaaagaacaattaaacctgggctttcatgtactcacccctaattactttctaccctggaataattttattccactattctactattctagcgatctttcataacctgctccctggagggaagttggaagaggaagaactatttattttcattatatttcttaggtcccttttcattagttctctttttactataattcaaggctttttaaaattgttttacagtatatatactgcttttgagccctgcaactgcccaaaatgcactattagttgctagcaagaatcatactaaaagaaaactcaagagtgcatttgtgtctcttctctaaaataattaggagagcactttgcagctaatgttctgctaatctatctgtatttctgacccaagacacagaatggtattattttcaacattctaagtttcatcagtgtctcaaataagaaagatgctaccttttatttttaaaaagttaaagctatttagccttttctcttcactaatacttgaaagctactccaacttatctcttcattcattcatcaaaaatgtggttaatattctactcaatgtaagacactgagttagaagttgggaatagaaaaatgatttttaaaatatccctgctctcaaggagcataatttgaacaccacatttttctaccaatttaaacattagatgattcaaaggaggaatataagcaaattaatgcaagaacagaaaaccaaatactgtatgttctcacttataagtggaagctaaacattgggtaatcatggacataaagatggcaacaacagatgctgaggactactaggcaggggagggaggggaggaatggttgaaaaactaacgtttgggtacaatgctcagcacctaggtccaactcaactttaaaaagcaaaggtaagtgaaagaccttctttaagtaatcaaagcagctcaaatttttccagcaaaaagtcttagtagaaacagtctcaaaaacggcaaaatcaaagtttaaaagccacttacaatgtcagcaaatgattcagaagaattctgagaggtagtatcaatttatagcccaaacctcaacatcatgcaatatacccaggtaacaaacctgcacatataccccctgaatctagaataaaagtagtagtaaaaaaaaaaaaaaaaaaggaaggatgcaggatgtgaaaagaaatgaatttgacttatcaaaacaagtacaactaagaaataatggtttaatataggtttgaaagaaattttagttaataataggatcctcttctcattgtcaggaaggtatttcaagacgtaaacgccattttccaccagtcttacccctttgcaacatcccatatgggacggtgcctttctgaagcttcagtatccctttgtttctattaaaccatgaggcatgatgttcattccagtataatgcgcatgcaggtgccaagaggctggaggtgaattggaacttaagaagccttttgtcacttagatttgtcttcgttaatctgttcatgatgtgtgtttgtgtgagactgtatttatttgatagttacaggaaaaaaaggaccattctaaattgctggacttaaaagagtcagatttctatttgaagaaaaaggtgcctaacttctgtttgattcaccctgtatgtatcttatcagtaatctctctctaatttggatgaactggtcttcacacatctcttttgtgcatacagagtggtcttgatcagtcacatcatacacatctcatctgcttttctttgaattaaagaatccggacagcaaaatcagaacactagcatggtcaccacagcattgaggtgtcctatacgagcataaaagacattaaaatccagactcggctgggacaattttatttgtgattttcctgaatcagggacaagatgcctttgttttataaagaaaatatgagcaggaccaggctcttctagcacaaaagcaggtggaggaatatacactccctccttagcagggaaggggaggggaaaaggaaggagggagggaggggagagagagaacataaaagattgagcagggaagggcacagcacgcctgtggaaatggactcctttcgtgtaaaaacaattacccagttcctgcagctgttcactagacttaatgccccaatgcattttgcatttatctttcctttccccttttccatgttcattaatttccacagttgaaaccagaagtgaaaaggggtaattctccctttgctattcagggtagaccacagcaattacctttgcttgtggcatgcttagtaaatgccagacactaagtaccttactatatcatcacatggaatcctcacgatactcctttgaattaggagtgaccacccctaatttacagatgaagaattggagactcaaggatctcacagcaagaggcagagccaagatctccccaaagcccacactttgagttcccaattctcaactagctgctgataattaaaatggaggtttcttcccattacagtgtgaataaactggttttatccatatatccctcagggacttgggcaccaaggaaactccatcttttccaaaggaggctgccaagttcctattccacatcagctgtagctttagaagtagactggcagtttagggattgtctgtggtctgggaatcatctcaaatacagtagagaagattgtcacccaaggtcccaatcagtttcaaaagtaaaactgctaggactttagaaatgttcaagtttattgtggtcaatggcaaaaactggtaaaatttctttgctcgctactccctgcccctttttaaccctcattgaatggttcataattggccatgagcaaaggcggccatccctatcactaagtccatcccccagctcacccccaaggactgctggtaagtaaaactgctcaataattaagtggagccctaattaatgagtctgattcctgcctgacacgggcacatttttaacctggtaaactcattaaacctctggtcttcatttagccatgggtgaccagagtatcataatttcaactaagtgtgctcagtgacttaatgggccttgagtttcccacattcccatagtgtcccatctgaggagctcaatcagtatcattagaagtttatttagtgcaaggagagatctctgatctgtcctgaattcaactgaaggctttaaagacgaatgaaagcaaaccgctggctccacaatttcaaacgacccattttgccttaaccgtaaatcagctaaggagtctgaaatgcagacagtttccagacagaccaggtcatctcctgagttaatgagacaacctgtgcttaagcacagtgcctgcctataccagcagatgccagcacttcctcttctcagataagaaagggcccagggatttggtccccactccacacattctgagatttttaaaataaaggcagattaaaagaaagaaaacaacacacacacaaaacacaaagattgttctctatctgctttcattctcagtttctgcccagttaatcacatcaaagagaattctcagaaagagctgttttctcattgttgttactgctatgtttgtgtgaatgtgtggatgtctaataaatagctttcttctaatgtaaaaaaaattcaaaactcaaacaagccagggctagtttggtttctaggttgtcataaaacccctgtcaatagcaagctcccagtaagtgttttataacagtgacagctttgcaaatactgtaacataagtaacttggactgggtcaatacatggcagggaaatcagactgtgagatggtcgagctgttcattttggctgtctttacaatcaatcagccagaccaactgagcctgcagtgatactcactgattattgagaaagctaaaacaaatggattggctgtgctgtctgccaaggcccattcaatagctacaacctctgtctggatacagacaggtgccatcttttgaaagccaaaattattagaaacaactctcaggtttatccaaaagtaggctgcactgtggctgccggaaggaaggaaggaaggaaagaaggaaggaaggaaggaagaagaaagaagggaaggaaggaaggaggaaggaaggaaggaaagaaagaaggaaggaagggaaagaaagaaaggcaggaaggcaggaaggaaggaaagaaaacaagaaaagaaattagttcggccgggtgtggtggctcacacctgtaaccccagcactttgggaggccgaggtgggcacatcatgaggtcaagagattgagaccatcctggctaacacggtgaaaccctgtctgtactaaaaataaaaaagaattagccgggcatggtggcgggcacctgtagtctcagctactcgggaggctgaggcaggagaatggcgtgaacctgggaggcagagcttgcagtgagctgagatcatgccactgcactccagcttgagggtcacagcgagactctgtctcaaaaaaaaaaaaaaaaaaaaagaaagaaagaaagaaagaaagaaagaaagaaagaaagaaattagttcaatgtatttcaatacactttgttggatagattttacagagcaacccattgtagaaagccaaagtttataggctttggtgccaggccacagcaataataatttctgtctcaccctaattgcctctttgtttcttctttggttatcttttgcttttgtgcttaattcaaaagcctgtaacagagcaatcatctcaaacatatttcccagctgtcaagataaaattcttaaaaagaaatccaagttccagaagtggaatgcgggactcttaagccctttcttataacctgcacaagtgactggatgtattaaactaccacagttccttgcaatattctttacttccagccaactcatctgtgactgctggaaggataagtgtattgtgtgagttgcctaatccaaatgtctctgagttgctaggtttaggccaagatgttccaataaaaatgaaggcaggctcccagtctttgcctaaagctgattcaaatcacatctacttagaatgaattatcttcacaatattttctttggggacttctctggttgtaataaagataacaaacaaaagctgcttatcaacatttccagttagagaaaaacgaaaattttaagtaaaataaatatatgtgagaacagtatttccaacttcattgaatttctttaaggatctggtagagattgaagaatagattgactgttaagaaaacagagctaacgggccgggcgcggtggctcacgcctgtaatcccagcactttgggaggccgaggcgggcggatcacgaggtcaggagatcgagaccacggtgaaaccccgtctctactaaaaatacaaaaaattagccgggcgcagtggcgggcgcctgtagtcccagctactcgggaggctgaggcaggagaatggcgtgaacccggaaggcggagcttgcagtgagcggagatcgcgccacagcactcccgcctgggcaacagaacgagactccgtctcaaaaaaaaaaaaaaaaaaaaaatgaaaacagagctaacaaaaggtggggtctcagagatttaaaatgtttattgtttattcatcctaaactactaactctctttggggtatgcaaaaattggctccccaccttccatttatttatttatttaattaattttatttttgagacggagtcttactctgttgcctaggctggagtgcagtggtgccatctcagctcactgcaacctctgccccctgagttcaagtgattctcctgcctcagcctcctgagaagctgggattacatgcacctgccaccatgcctggctaatttttatatttttagtagagacgcggtttcaccatgttggccaggatggtcttgaactcccgatctcaggtgatctgcacgcctcggcctcccaaagtgctgggattacaggcatgagccactgcgcctggcccccaccttccatttaatccaatctttggaggaatcaaattaaggggatgacagtggtgcaacgatttttcctagatatgaaggaactcatgtgcaggccagcaaaagaagatagagggaaatgtatgtgatcatactaacaagaaatacataacaaaatgtgatgaaatagtcaaaggctttcaagtctactgtgttggagactggtagttgcctcaccaatctatattcttccatttgaaaaaaaatcacttaagcaatagaatctcctgagttttatctgagtggctgtccagtggagactgcatttcccagccttccttgcagctaggtgtgatctcatgactaagtttggctaatgagtagtgtacagaagggtcatgtcctcaaaaggaagctgcttgctcttcactttctcttttccccttcccaaggactggaacatagacatggtggtggttcattactgaccatgtggattagaacaacacctagtggatagtgaaaagaaagaagacacttggatcatggatcaccttgtggaatgacactatcccacaaccctggactgcctaccagtctgcatgtttatgaaagaggtggtttcacggagtgccttgctaatcgagtgtggtgtttagaccagcagcggcacccgggaacttattagaaatgcagaatcccagacccatccactgaattgtataattcgcatttaaaaaacatctcctgacaattcatatgcacattggaagttgacgagcatgggtatagtggttaaaaggatagattctggtgccagagcctgggttcaaatccaaatctgtgacttaattagttgtgtctctttgggcaaattattaaaattctatgtggctcagctttcttatctgtaaattaaggatattaataatatcttccttatagggttgttgtaagaattatatcaggtaatataagtaaatatataaagctatcagttggtataaagctatagaagagtttgctattatttttattacaaaaaaacttctatcttgtttaagctatttggtctctgataaagctgtcagacttacagatttattataaaatctgtccagggccagcaaggtttttgcataatagagagactttgtaaccacaggaaatctgcaaactaacattttaataaatccatccactgttaaaataataggtctgggtgaagatttggagaagggtagaaattgtgtcaagtcttataacaaccacgtatcttggcactttcaggataacctttgcagtaacatgtattcatattcgatgaacatttattaagcatatacttatgtgtcaggcattttcctaggtacttgggatgtatcagtaaagaaaactgacaaaaatcacccccctcatgaagttcatattctactgcaagtgtgggaagtggtctggagatggggagtatccatcaagtttagatttcattatcaggttgtggctcagactatgtttcctaattactagcttggaaaatgtaaacatcataacaaaaggaagtgaaaaatagattgaaacatcccggagcctatgagattgtggttactataaaatctgtccagggccagaaaggtttttgcaaaatggagagactttgtgaccacaggaaatctgtattccaaagcaagtcagaagcacatctgacatcaaaggttctaccaactgtagagctgggatgttctccagttaagttctctggatgatcttacacattgctgaagagcaggtaaggggctcctccatcaggcctttgatgagttcccgccaggaagtatcacttcatcattaagaggtttggccataatgggaacttacttcatagaacttttggggaagtgtccaaatcttccaccaatttctttaagattgtattgttgtttttcttaagttgtgtgtgtgtgtgtgtgtgtgtgtgtgtgtgtgtgttttaacatattctggatatttttttcaaacctgtgacttagcttctcattttcttaacagtgtctttagaagaggaaaagttttttatttttacaaagtccaacttaccaattgtttcttttatggcttagtgttcgtacgtatatatgttctaagaaatatttgcttaacctaatgtcacaaaggatattttcccccttttttctctagaatatttacagttttagttcttatatttaggtctatggcacattttgaattaatttttgtgtaatgtttgaggtaaggtcaagatttattttttttttctatatagatatccggtgtctggtgcagtttgttaaaagacactatcgtttttccattgaattgccttgttaattggccataaaaagatttatgtctgaagtctattctgttccactgatttttatatttatacttaaaacaatatcacagaatctggattattgtggctttgtaaatcaagaaattaggtagtataaatcctccaaacttagtctttcacaaaattgtcatgattattctcgttcctttaccatttgatataaattttagaattttctcatcaatttcatctcttacaacctcacaaggattttaattggggttacaatgaatctatggatcaatttaaggagaactgacatttttacaatgttgagttttctaatccatgagcatgatttatctccatttatgtaggtatttaatttcctttggcaatgttttgtagttaagtgtgcaagtcttgcagaattttgttaaatttattcccaagtattttatttttgatgctattataaatggagttgcttttaaatcttaatttctaaattatttattgatggtatatagaaacaattgatttttgtatattgatgttgtatcctgtatccttaccaaattcatttgtcttcagtagctttagattccttaagcattctcttcatacataaatatgttgtctgcaaataaaacagttttatattttcttttccaatatgcaaggcttttattcatttctcttgccttattgcactggttatgacctatagttcaagttttgagagtggatatccttcaatttttctagatcttagatataaagcatcgaggcattcaccactgtgtatcttagctgtagttttttgtcactattgtctgtctggttttatcttgaaagtgcccttaatcagactagtaaattccatttcattcccgatttcctcagagtttttatcatacctgagatataactttgcctaatggcttttttatatctaacaagataatcacatatttttgtttctttcttgtgacatattatctcatatacattgttgggtttggttggctaatatttgccaagcatttttttttttttttttgccagtgttcatgaggtgcaatcgtctgtagttttcttgtgtttctttgtctatattcagtacaagggtaatactggctttataatattagttgggaagtattttctacacctctgttttctgaaagaatttgtataagactagtattagttcttccttaaatgtttggtaaacttttactcatgaagccatctgggtctggatttttaaaaatatatgtttgataaggtttataattacaaatttattttttaaagtagtataaggctattaacattctctatttcttcttgggtcagtttttgaaagttttatttttcaaatactggatcaaatacttgggtcatttcatccaagttgccaatttattattcataacattgccttattatccctttaatgtttttagcatttaatgtatttagcatctgtatcttgtcccctctttcattcttgacattggtaatttgtgtcttccctgttcttttagattggtatgactataagcgtaacgatttcattgatttttcccaaagaatattttttctgttgtttgtccattctctattgtattgatattccttctcctgcacagctctaagttagtaagtgagaattgatcttagaagcacatgaaaacatatgggaaacaaaacaaggaaaaatatttaacaactatagttttcaatgtgttcagctagatatcatggcagatctgagaaacacacatgtagttctctgtgcttaaggatattattatctagtactctgcctctcaaacgtttccataaagttataccaaatggcaggaaagattgaataagtacttttcatgacatagggcagatattctcagacgtttttatgttcatggaaaacctagtgtctcagttttctcaaggcacctcagatcaaaagaaacctacaaaattccatttattaagtagataggtccaaaatcatttaatttttatttcctaataacaagtagccattaaataacaatacaaatatttatattcaagtcttaaataactacaattacttattaatgggatatacacctgttaggcactgaacaacttttaaaactttggactcacatactgcctatttgttttacatttattttcatgcattagttgctttttttcatggcaactgctaaaaacccagcttatcaaagatatgatgttatcaaaagaaatgtagtataatctaatactgaaaatattatcctgagctagtagttttcacactgtcctattgatattgaatatctctactttttcctaaaaaaaaaaaagtatcccatgatgccccattagttcaccgtagttccctgaggtgcctcagcacagtttgggaactatgggtctagggtaaaaaagaagaaagctcctgagatccaaatttccttgaaagtttaaatatgttaaatctttaagattcatctgaagtttttcctctattaaatgatacatttgtatttaaacatgattttacactttataaatttccctatatttattttatggatccttgtattccctgagatatcatagcagagtcctggggatacctctactgcaacttgagagagaaggatctagctatggaaataagataatgtatgcagatgagaggttagccaaaaacccaaggcaactcaaacactaatgctggataaggaggaagtaagacaatgtaaccaagtaatttacagtcttaaccaggatctttctgagactgaaagggaatggtaccaatagtaattgggaaaatagacataaacataggctatcccagataaacagggaggcatgtttccccaggaaagattggaaatcattgattttgcaaatatagtgggactatgcatgtattagccaataaaacatcttccgccagattttttttttttaaatctagagagtccatattatatccacctctagttctaagaatactgaaacatttccctcaagattgcaaccccttctctagggaaaatagcataaccaggtcttatttttcacacaatgcctaactctgaggaacatctttcagtgaggaagccttccctacattcttctgagaggtgcagtgttgttgcctctttactggagaagttatcctcttctgcccacatctataagaagagaatctggaaccagtaacaaccaacaatcctgtgggttaacaattaccatttaaatcagcaaactgacatctaaggaacttaaaattatgtatgtagatggtaatgccatcttttcttttacaggaaaaagaggaggctgccatttttttttagttttttaactatatactcaattctaattctggtaaaaattattttatttctctacatttttgatttagccactttaatcaattctaagatacaaatatctttatattatgctctttctgaaattaggatgtgtcccacaattaatgatatatcatagtttaattggattaggtaattgtttcctgtgtggtggcacataacataatgatgtatctttataagtaatggggtcttagatttaaagagataaagttattattccataagagaaaggtgatactattcatgttggagtgatgtaaagattcaacaaaaaaattttgtttacaggtagtaaatatggtagagtgaataaaaaactaggatatgagtagaaattctcaggttttttttttttttgttttccttttttattgagatgttagtaagggtttttgttgccaaaacaagtgagagatacaagcataaaagaagacacagataagttgtcttgataattttagactctaagatctctctatggaaaggtcagctacttttgtagacaagatactatccaaaataaaaacaacaggtatttgaggcagtgttcaagacaatgactgaatacatatgtaatatgtaaaaataaaaatgtagattcctattttctttcctcaataagctatgtgagcatataaaggtatgggtctgcttttggggaaaaatgcttttctatagaaaaattctaatttcctccatcctctcccaaaaaaaggttttaagccctcagatgagcaaggaaatcaatcaggataacactagtttcacatgaacctcaagactataactatagttactatcttcttttcttaaaaaaaactttagcttccttttatctgtaccaaaccagtacactaaattttctcccttacaaaattttcaaccaagttggaattaaattaatctcactgtaaaatacaagaaagaataggtaagcccagtgtttgctctgtgtaatgcataaaacagaagcatttctccaacagcactagccctagaggtaccacattaagaactggctgcaggacaaagtgatcccttaggtctactaacaaggcagggagaggagagtccagtttcagcaaagatgaggattccctgctacgctctacgtttagcttttagttgtagccagatctcaaacagatcctaggtccccctaactgacaaggccagaacatagtaccttcacagggtcaagagggccaaagttgtctaaactagtcagtgaacatctctgctccataatttgttaatgctcacaatgatagcgctacaggcatcaagaagcctgggttttggaacaacttacacatttgttatagcaaaatatttgtgtccccctgacattcctgtgttgaaacctaatcaccagtgtaatggtacttagcagcggtggctttttggttgtgattaggtcattgtattagtctgttttcacgctgataaagacatatccgagactgggaagaaaaagaggtttaatggacttacagttccacgtggctggggaggcctcacaattgtgatggaaggcaaggaggagcaagtgacatcttactgtatggcagcaggcaagagagagagcttgtgaagggaaactcccgtttttaaaaccatcagatctcatcagacttattcactatcacgagaacagcatgggaaagacccgcctccatgattcaattacctcccaccagattcctcccatgacacatggaaattgtaggaattacaattagagatgagatttgggtggagacacagccaaaccatatcagtcatgaaggcatagccctcatgaatgggattggtgcccttataaaatagacctctctcgtaccttttgtcatgtgaggacacagcaaaaagatagctgtctatacaccaggaagtaggccctcaccagacactgcatctgtggaggcttggtcttggacttcccagcctccggactgtgagaaataaatttctgatgtttataagccatccagtctacggtattttgttgtaacagcctgaactgactaagacaacatcatttacctaataagcagtgataaacgttcttgtctagagtaaatgatacgaaatataatacattactgctgaggttatttagtctgactttaaattaaagcagtacaaatgacttcttccatacaataaagacaaactttgtactcatgcttctcaaagccagttgtgtctctagatctagcctcagtttaacaatttttaaaaaaaaatacctttcctaggtcagcgctaagatgaaaaaggagtagcgagcaaaacactctatatccagaatccctgtaatagaaagagctctagaatccagcaggttcaagcacattcaagtttgagattgtggtctgtggcaatcgtttctgtccttctatctctggaatgttcatcttgggtggcttgaaggttgctggattcacagccattcagttggcctggatataacctgagcataggtcagttccactgggaagggccactgtgctcctttgtagcccaggtgacaaagcctcctgaagcagactcctgaggtgggggtggaagtatgggggtctttgttcaaaactgctccatttatctgatgagtctgtctttatccccatttctgaaactggactttgctggaatttggaccagataaggctgtagaagaaccagaagtgaaccagtctcggtttttgcttagggaaagagtcggggtgctgcttggagtggacagggtcattcaagcggcctctctttcttcgttatttcttcccgtttggtttgtggaatgcttctgtcactcaaaggttcttgatctccttggtgggaggaacttcgtggggtgtgtagccagcatcattcggccttgtttgttgctcaaaatactgaatgctgtcctgtgtgttttgtaataattcatgatgacaatggtagctctatccttcaccaccaggatcttgtccatactgtcagtggccataggatcatggtaggggggacacacagtcccctcttattccaccaaggtactgaaataacttgtttccagggaatgctgctcatggctagggaagaggaatcaatgtgtagggtctttgagggcatcctcatagcctggcagttacagactcgtggggagggatatcttgcctagggaacccctaggcttaagagccggctctcctcgttgtcttgaagccactgaaaaactaggatccaggtgatttagagctgagtgcctgccaccacagtgaaatgatgtgacaattatgctgacagatactaacgaggaacaccacccagctgttgcaaattagcaaggcttccctggtaaagtccacacagaggtctgtttctttgccaccatggggattcctgcaacccaagctccacagtacagacagaggctttatggtgcagtcaggacccaagccacggtgtgcacggcactgtactgtactccaggcaggtctgaacctcgggtgcagatcggcgagcacgtgctgtgcaagtctaggattccagtgttaactttcctctttactagctaagtgacactgaacaagacacaatctctctgaggctgtttctttgtctgaaaaatgaggatcaaatacctgctctgtctatttcatggggttcttggaacatcaaatagtctttgttctcattggttttatgaatcatggaggcataatataaatgtgtgaaataaaagacaaggcatgtaaaaatactgtgtgagatttaaaggggcacacaaatgcaaaaattactgtttgtgactttttaataaacgcaaggtaaaatatcatttttatattcaattaaatccaaccatcatttttgaggccctgctttaatacatgattctttgggatgtagtgttaaattatccacatgcaccctaagtctgaacaatttttgtgtagcaagtcccccatcccctgccaaaaaaagcaaagctatagcaaccagtgttctggtgttctatggccttttttccctaagatccacactttgcttttcgctaacccatctctcactgtaaatgtgtacaggaacaagatgtgagtaccgtagattaaggctagagataattggcagaacataggagaagaatcagtgatgagggagaaggtgggagagaaaaagagggacctgggaattggaaagaagaaaagacaatgtacaaataaaatcaatcctcccaattgtggcatgcagagagaaagaaccaagctacaaaaatggattcaatcagattcaatcaatcagatgccagatggacatggctttaaaaaatgaggctattatcactgaagttcatttgacagagcttatgtataagagtcaagcgatgatcactcttgtctacaatcataaaataaggtgccacggtgatttatcactttactcttctaatataacccaacctttagcagtgtctataaatttggttcctaccttttgaaaactcttactgtatcactgtaaattagcccattccttggcacatactaggcatttgataagtgtctggtgaataaatgaactgaaagaatgcagacctagttatgttattttatcttttcatggtgttgaaggattcaaaactagaaaataacactccccctttcaccctcttatttcctcaaacacaagactcttatttaagattcctctagtctatgcagataacttaacaattgctggtactcactgaatgattactgtgctgggtagtgtgttaagaagtttacacgatctcactcaatccttgcaacaacaagtgagcacgtgattatcccactttaaaaatggagaaagtaaaattcagggaggctacccttagaaagggaaaaagtttatacacctagtaagttgggataagggtaaccaattggatatgcttttctttaataattatattttcatagaaaaggctcaaggaagcacaccaagaattacaactacccttttctaaattgcaaaggcctgcagaaagtgtgtccgttgaggataagctattggcagtgaccttgaggacagaaggagtggctagagcaggagcatttcattgtttcttgatgccaaccaaagtaagaaatgcattttatatcctaacacacacatacacacacacactcacacataaccacacatacgtatgtacataactgaaataaaacttttactgagcaatgcttactgccactatgtgtgacgcatgatattttccattctgttcccttccatttacttttctttccttcccttcccttccattctattctattctatttctttaaatgctgtttgggacccacttataattgacttcactgtgcattcgtgtgtaatgagctgcagtttggaaaccaatgaggtggaaggcaataaaattagtaggaagagaatggaattttgattcccttgtgagactggaaccttgggctgctattgtgtgggctaaagcaaataataatttctttgaacttcagtttctcacccataaaatgggggtaataatacatacctcaaagggatgctgagaagagtgagcgacaaacatacacacctactctagtacttagtgtgtcccacagatgtatggtgacagcagtgtaatgaggtggttaggaatgcagaatgctgggccctgtcacaaactagctgtgtgatcttaggcaaatcacataatctccaagctgtggtttactcctgtgtaaaaaatgaggaaacagtagtatttacttcacagggttgtcgtgagcattaagtgtgataacatatgtaaagctctgagcacaatgcctggtgtgtagtaagtgctcaataaattattggctatatcatctattcagcaaatatatctattattattgcccaactacttagagctactctggaatgccctagactaggtgacaatatatattttgatgggacaaattcaggattagaggggtgggtgtgtgtgtgtgtgtgtgtgtgtgtgtgagtgagagaaaggagaaagagagaagaaaggagaaagagaagaaaggagagagagacagaagaaaggagagagagacagaagaaaggggagagagagagagagagagagagagaaataatacatatgtaacaaacctgcacgttgtgcacacgtaccctaaaacttaaagtataataataataaaaaaaaagaaatcagaattactctattttactcactggtatcttcaagaggccaaatcaaacttggctgcagcaaaggaaaatatttttagtaaagaaaggttagatccaaaactggattccctctctttgtttttgacagtatttccacaaaacccaatctttggcatggggttaaaagccttttttttctttccaataagtagacttaacaaaaaaatgaataaaggaaagaactctacatattaagtagtggaaagtaagtttcatcctttggaggttagctaaagaactctatggcatggccccacactccctaaagccttccttcttgccacctgtgccaggtaacctctaagatgcccccaatacttcctggtattcatgctctgtgtaatactctcttcctgtcaagtgtggattggactaagtaactcatttctaactaataggataaagtggaaatgacagtgtatgacttagagactatgtcataagaggtaatatggcttcgcctctctcttctggagcttactctgagggaaggtagctgccatgttgtgagcagcgccatgggaagcccatgtgatgaaaaactaaagcctcccacctacagtcagggaagtgaacttggaaactgatcctccagactcttcaaaagaatgtagtcccagccaacagataccctgaaccagaaccacccagataaaccactcctagattcttgactctcagaaactatgagataatatatgttgttttaagctgctatgtttggggataattgttatacagtaatagatagctaatatatcacccttgaatcttgcttcccacaccatctgtgttaggtcagtcagttaatgattcatttattctctcattcattccatgaacttttatggactgctcattatgtgttgggcagtgtgactgtcttcaaatcctcactttaaggagttgctctgttctgttccattgatctatatctctgtttttgtagcagtaccatgctgttttggttactgtagccttgtagtatagtttgaagtcaggtagcgtgatgcctccagctttgttcttttagcttaggattgacttggcgatgcgggctctttttggttccatatgaactttaaagtagttttttccaattctgtgaagaaagtcattggtagcctgatggggatggcattgaatctataaattaccttgggcaatatggccattttcacaatattgattcttcctacccatgagcatggaatgttcttccatttgtttgtatcctcttttatttcattgagcagtggtttgtagttctccttgaagaggtccttcccgtcccttgtaagttggattcctaagtattttattctctttgaagcaattgtgaatgggagttcactcatgatttggctctctgtctgttattggtgtataagaatgcttgtgatttttgtacattgattttgaacctgagactttgctgaagctgcttatcagcttaaggagattttgggctgagactatggggttttctagatatacaatcatgttgtctgcaaacagggacaatttgacttcctcttttcctaattgaataccctttatttccttctcctgcctaactgccctggccagaacttccaacactatgttgaataggagtggtgatagagggcatccctgtcttgtgccagttttcaaagggaatgcttccagtttttgcccattcagtatgatattggctgtgggtttttcatagatagctcttattattttgagatacgtcccatcaatacctaagccctcagaaataacgccgcatatctacaactatctgatctttgacaaacctgacaaaaacaagaaatggggaaaggattccctatttaataaatggtgctgggaaaactggctagccatatgtagaaagctgaaactggatcccttccttacaccttatatacaaattaattcaagatggattaaagacttacatgttagacctaaaaccataaaaaccctagaagaaaacctaggcaataccattcaggacataggcatgggtaaggacgtcgtgtctaaaacaccaaaagcaatggcaacaaaagccaaaattgacaaatgggatctcattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaacaagtgggtgaaggacatgaacagacacttctcaaaagaagacatttatgcagccaaaaaacacatgaaaaaatgctcaccatcactggccatcagagaaatgcaaatcaaaaccacagtgagataccatctcacaccagttagaatgacaatcattaaaaagtcaggaaacaacagctgctggagaggatgtggagaaataggaacacttttacactgttggtgggactgtaaactagttcaaccattgtggaagtcagtgtggcgattcctcggggacctagaactagaaataccatttgacccagccatcccattactgggtatatacccaaaggactatgaatcatgctgctataaagacacatgcacacgtatgtttatagcggcactattcacaatagcaaagacttggaatccacccaaatgtccaacaatgatagactggattaagaaaatgtggcacatatacaccatggaatactatgcagccataaaaaatgatgagttcatgtcctttgtagggacatggatgaaattggaaatcatcatactcagtaaactatcgcaaggacaaaaaaccaaacaccgcatgttctcattcatagatgagaattgaacaatgagaccacatggacacaggaaggggaacatcacactctggggactgttgtggggtggggggaggggggagggatagcatgaggagatatacctaatgctaaatgacgagttaatgggtgcagcacaccagcatggcacatgtatacatatgtaactaacctgcacattgtgcacatgtaccctaaaacttaaagtaaaataataataataataataaaaaaaggagttgcagtcaagtggtggatatacagtgggcagaccattactgtttaaaatgctaggtgcatgctaagtgccactatgtggttttgatagagggccttcaggactcagaggaggaacaaggacttcctgcctgggcaaatgaaaggatacagagaggagatggcactggacctaagccttgataccaaggtatgatggctttgccatatgtccacttggttggactgaactgccttccccagaattccctttcttctatgtttctaggctgggtggggcacaagggagattcccacccaaggagaagggaagcagtggccatttcttagtgcacaggtgtgtggggctgctaactcactttgttggcgtgaagcagcagctggcctgccattgctctaccttcccctgtggtcttctgtagcatgtctgacttccaggtcaagtgtgtgtttagctctgggataaagggcttcagcttctgaaggatactctcatcagtaaggtgagaagcaacgagacgggacacggtcctttttttgcttgaggtgccagcctactcctgattttctcttcctgtcttccccatggagttcaagctccagccacatgtagagacaacagccttatggagactgcgtaaccagctcccacgatcgtgtagatcgtgtaagccagttccctgtgacacacaggtggaaatgacgagaaagagcgttggaggcagagggaataacaggaacacaggagtggaagagaaaaggtagaagtaataccataaccacttgtataacaccagtagtgaccaatcagaatgaatcattaccccagcactgaccaatcagaatgaaggcagaccgcagcactggccaatcagaacaaatgcttgccacagtgctgaagcagggtcctggatggcccggctgtgtcccttttagttactgaattataaggtcttactgaggagaagtctgagtgggtcttgtggtggttaaaagtatgggagtggggatcagagaaccaactatttgccaactagtacagaaatgttttaatatttcaacaacttgcactatcatactgatgcattccagctaaatagaagctctgagaaaatatgcgtggtgtgtgtgatgcgtagcaagttgtttaatgttgctggctcgtggtatggctgtagttttaaccacccggtgactcaattcagtgaaattgatttaacctgttttgtcttaagtggccatagtcaaaatagctatgaaaacaattccatggcaaaatgctattttataccaatcacagatgaccaagaacctatgctttcactgaatgagggatcaaaaagcaggaattttagccagtgttctgctactgtcacattgtgacctgggaaagtcatttaccacgacccatcctgcaaccagaaggaatggccttacttgggctttcctctgtgtaatcttcttgagactggaatgatcctccattccttaaaactatgagtaaagacatatttcacccaagaaacctgccctacatctcattggctcggcatgaaatttttagcttgtggtaattattttacatgaattgatattatattccctgttctctttaggtagcatcacaggtgtgcagcttattcctccttttgattggcttgatctctcaacagatgcataatttaccggacatcccttttatactctgtaatgtcccctgctacctagagctccgcatacagcaggtgcttaataaatacttaagcgtccatatagcattttggtaaatgttccagttccaaataaaaatcaaacaggatatttttgtgtatttaagggttttggattgtgtctagcgtggtatttctctctacttcccttccactggcatgaataattaataatagagttggaactccgtgtgtgcatgcccataatagtatttgtgtgcatataataatggtgtaaaacttaactcattttgcttcaaataaaaagccattcctgtttaacaattagcgggtatgaacacaaagatcattttagcatcttagagccaataatttcttgtagctaagctaaagctaccaaaaattaatatttatcattaaggagaaattcaaatcttaaacagagaaaaataatacaatcaactctagacacttaaatattcttgtccttggagagttagggcagttgggcttaatctgccacattctcactaataaaaatgtcactattgaactcactgttcttttggaaaatgagaaatacaaattgaacattctatagggaaaaatcaatacaggaaagtgttggactatggttttaaaataagcttctaaacccaaacaaaaagtagatatacaattaacagagtagtggaatgcgaatgcaattgctgagagtatgaaattttgaatatgaactctttcctctcaagcaattgaattagtagaagaaattactaagaaaaagctgaacagagatgactacaaataaataaaaattttaagccttttgatattactgtgagaccaatttttcttcttaagcctggaagaatttctgaaaaattctaaggtaggtgtttgatcttttctgcttgacttattttttctacttagcacatacacatttatttgaatttgaaaatgtttactgcacccatgtgtaaaaattaacatatatatttaccatgaccttgtgatgtatacaaggcagaatggaatgagaatatttcttctccagtctatttctctggaataaatcataaattgttccattgttattaaaccattttttaatagttcagctcccagcattagcatcaataaattcctcttctaaatatagaaagcaagtcactattttctttaactttcataacctcatccattccttcaactagtttttcacttacacatacttgtacacatacttgtatgtgtaagtgaacaaactggtttttaattcttagcaaactgctcattccccaacagatgaagtgtctcttaatctatgccagtgctctttagtcagaattggtcttctgagtctatattttgccccctatcactttgctttcataaagagcatcacagaagcttattcattagcattcagagtcagtctctaatgtaggggtagctctgatgcaatttacgtttagttctttccatgcttccagttctttatatcaagccctcctgttagctctgaggataagtgagccaattggaaaaggttttgagcccttagcaaatctcatcataagatatatccaaacactgtaatctgaatgcaatcttcattaagaatttccaccacctgcttgctgaagccacagcacagctccactcataatcaccatgcagggggcagcattagttaatgtcattagacaaatgttgccatctccttgtgcatgttcattagcaccaggtgggaaaatacaggcatggaaattttgggttgattcaggcttggacattatttattcagctaactttctgagcatccttgaaaaaccaaaaaggttggatttgaaataacttttttaaaaacatacttcaggggcagtgtcagagttcaacttcactaatggaagtagagggttactttcccagaggtatggcattgggtaagttgcttactctcttggtttccccacctataaaatagggaggataattttatctaccttatagggtttgtattcagattaaatgagttgatacaaataaagcactttgaacagagcctggtttgttttcatcatcataatcttcatcatcatctttgttatgctaactctgctttccattgttcatctgagcacaccagggagcccacagggacccacatgggccacagagagtaatttgactctgaaacacagcagcttttgttttcttttctttttaacctacatccttggagcacttactaagtgccagtcactatgctaaactgtttgcaaacattttctcatgcaaacctcacaacaaggctaacaagatagatacaaaactgtattacaatttccattttatagatgaggaaattggaatttggagaagttaatttgcttatagaaataaggtccacagactctaagaagtggatagacttgtatttcatactaactttgttttaggtgttatattgacctcaagaccaattatgaaacaaatatttagagctggaaagcctttcccattcatgtagtgcacatgtaggagttaagacttagagaagttaaggacttcacccaaggtcacacagccagctgtgactagctggcatcagaacatttacagaggtccttggccctctaatgctctgctttttctctatatattattttacgtcattaacagattgctccaaatgtgaaaatattcaaactgtgcattcatctcaaggcatgagtttctgcagcaaggaaatcatttatataaatggaaaattaactgaagggagaaaagaaatacttgggataggtttttgaaatttaaacacaattgcttaagtaacatcttaaaagatggcattaaagtcataccccagaagccacaaatatgataataaaaggtttacagtggctgttctaccagacattcttcaatcccattttctttccagtgtttataactagcacggaactgaggcaattaagaacagctttctttcagcttctctaaggcttcttgtgttttaaacctgaattcctgaggccagggaggaaaagggaattccctaacctctgcgtccgccacctcctttgccacacacacacacacacacacacacacacacacacacacacacttcttcctcccagaatgaagaatttccttcattcttttcctttttcatctcttctgtctcacagcctccactccctcccccaaaacctaaacttcagaacttggctcagtgacattccctcaagatcaaagttaaatgataatttccataaaaaccaaagtcatttcagtctcactatctctctgaaagtctgagtctcatgccaataaagcacaaaaaaattccacactccctttctcttcaatatgaaagtccatgctccctcttcctttcttctggtgtctcttcactcctcacacattactgcttttctgcagagatgtccacagtaagttccaccttctaatttaagatttagctacttccagtgcctctttttctctcctggataggcaatgcctgtgaggattgaggctacagtagtaagaaaagaaccaagaagcaaggcggtagaaagttggaagacagagagagagagcagtgatgaagaggggattgtaggaaattcacataattacttcaaatattaaagatcatagagcttgtaagtgacttggttaaaatactaactcaaggctttttgacctgagtcaaacaaaatccaattgttgagaatatcataacaaaagggatgaagactggtcccaataggagttatgagctatactagggattgcaatataaagtgtctgtgcaagagtgtgagtcagtgacataaatatggggaagagtgggagagactacaggacatcatgataccacctttacatatttctgtggccttgcttcacacatcttcagaaggaatcctctacctgaccttattcagcacaaataatgggctgagagcaacagcaagcaagctgcagtctggacaaggccccttcccttctcactgcccccatcacccctccacgcataaccacagatatgaccaggtagctcctttattgcaaggtgaatgaggaggttctgattttcccctgaaagtggaagggaaccctttctgaaatcactgatatttttcaggaatccttccacaaagtcactaactggagagttaactgatagcagggggagtacatatttccctttgtctaagatgtcaccaagttttatgtaaattaaaataattgtctccctcaagaaatggaaatagtaatactccatttagttgtgaagtaacttcagaaagagaaaatacaggtgtgtgagtgttttttctttttcttatttgaaaggaaaatatcaaattcctaacacagaaaatctccctgagagtctgcctccagtaggaaagcttattttgaattctgcaagttttatgagaaaagcattaagctctaataagtagcaattttagtattattccttggatgttaagttcatttgttgagaatacaataataccatgggatgaagactggtccccatagaagttataaactatcttaggaattatgacatgaaatgttcatatatcaattataaaaaatgaatctattttctgttgctccattttcagttagtaggagaaaaaaagtattctacagagtctgtttaaacaaacagaaaaatgaaatcctagagtatatattcaataacaccttggcttgatagacagtcctgacttggaagtatgaatcaacaagtggtttttctgatatgattggacagaaatataagataatggaaggtagaactaacatttcatgatcatactcctatgtccattgtcacctaactttgtagtgctatcccactcctattctgggctcagccttatgacctgggttggtcaatgggatactaacaaatgtggggcaaacagagatctgaaaagcacttatgggtttccacttgttcttgtcctctaccatagccataagcatgtatttgcattatccttctgctcgcacagagtagagcaaaagtcacctcagtcatcctagctgaaactatcctaggtcagtcaacaaccagccaatccctgcacaagacaaaaagaatgtcttagctgacccaagatcagcaaaatctcctagcatgccttccagatgcatgagtaaagaatgtttattgttgtgtcatttgtggtggtctgttatacagcatgattatggtactagataactaatacaaaacctacagtgatgaaatggtttctggatatcaaaacatattgtatattgtgttacatgttatatgaaagctacagtagggatatgtgttaagacagactggtaggcctgtatggccaagccacttccaggcaggggaaggattctcacttaaaagagattattcctggtaccaaccactcagggaaaagcagtgtctccccaagtagaaattgaatctgacagtatggaccattgtcaattggatgatatggcagggtctctcctgggcaggagcatttgtctagcaggatgtttctctgagaggccattcagaatgacacttctgctgtgtggggactgaccaggagctgagcagtgaaggacccacgaggttccatgtgatcactttggtaatgatgatgatgatgatgacgatggctgacaccaactgagcaggttgcttattatgtcccaggtaatatactcagcccttgatgtatgtcaactcatttaatcttcataacaaccctataaggcaggcattttctttccctcattttatacttcaggaaactgaaacccagagctagaatattaagtgacctttgtcctttgactaaggacaaaataacaactaacaagtagagctagatggccacaaatctggctcaagaactctattctaaagagcttagggaaccaaacaacaaacaagttgagtaaggacgaggactttatactttgttagctgggttgctgatggtcctagtactatgtttctgacactgcatggtcaggaatttttcaccactatgaggccagtatcttggtggcagtaggaagggaatagaaagagagagagagctactgtggcaatgagagtgagagagagagaaagaaggaagaaaatcttgatgagaaggtaaagttggggcatgaagtcaaatgccgttagtcagggggctttactttgttcccagttttcccaggagactgtctacaggtgctaattccttagaggttctgggtttaattttactgaagaggtggtacttccttatgttttgtatgtgccaggcagttttgtaagcttttcacatacattatgcattgaattctaactacaacctttcaaagaagaaagggacttttatccttaaagatcagtgctattcgaagtgtgattcctggacgtgtggcaggctgtgaactctttctttccagtccacagcgagatgatacagaaattaaaagtggctgtttagaagcttttagagagaaattttctgcttgttgaatctaataatctaaaaaaatgagtgcatatcttatatgtctacattttctatttaattttcctggtaattcatatattttacaaaagtatttttcctcaaatggattggaaatttaagaaatacaatttgggaagtactattctataccatggaattgaggctcagagaaagtgagcaaccttgccaaagtttctgtcattacgagaagagcagcaggactcaaactcaagtcttaatctaatgcccaaattaatgtccaacttgactctacctgcccacacttgcctgtttaaataacgatgttaagctcatcttttggggggtgggaagaggatgatgggatctttcaactggtgatcagccaggccatcacaaagtgtagaaataggactttaaaaaccaaagggaagccaggtgcagtggtgtgcgactgtagtcccagctactcgggagcctgaggtgggaggattgcctgaacccaggtgtttgaggccagcctgggcaacacaatgagaaccccatttctaaaaacaaacaaaaactaaatcaaaatgatgctaccagtgttcttgtgtagcagacactgcaatgtgcaatgccatggcatttatccgggacatgatttatgcagcatgacttggaaatcacagtgaaatcttttctcttgctccttctgcaactccctaagggagaaaaataagaaacacataaaattctcatttaagaaaaattatttaacagaccctacatccagtgaagcagttcattttgtggttggaaattcaaaggaatttttttctatcatctgttaaaagaaaatcatgctgtgattacagcaaggagtagtagatagacgtgggcgttggagcaagacacacttagatttgggtcctgcctttaccattttcttgctatgtaatcttggcatcatgctaatatttctgaattttgtcctcatttgtaaaatgtgaataatccataactcacaggatttggggataatttaataaaggtaactcacatcaattactttcatcaaatacaaagtagaaggataattataccagatacctccaaaccagatacattttacccgcttgtttaagattctttcaaatgctgtggctatacaatttcaaaataattaactaaaaggttgtttaaaattgtttagttatttagatagtaggtttttttgaagtacgggataaaacaaggttattggactcaattttaaaaattgactagctaaatgtttgcatgttttgtttccctatagaaaaagtgtaataagttaggatgatattctggtttatcatacactgaaacttgtttcattaaatttgtgatctattcacatttatagattattgataatcttatctcataaggatgttggagagtcataagaggaagtcaaattagattatgtaatatatggtttccggtatatgataagcactgaataaatgtatttctcccttattctactttacttataggtgctataatttctaggagaatgccactctatagaatttaattatatacaattactactattgtagattcctacattaagacttaacagaatgaaataatttctacttggaaggtagaagtacagtgatttaacactgctatgaatttgtcctgaaaccctatagtgaaatttctccaaatgaacaataataaaatatctatgatagacaatttttaaggtctgtactccaagcagtttctaaagtggcagggagcctttggcatttcctcagtaattggtccctaaattgtgtcaacaagtgcttatgtactctttacagttttgcctgcttttgcctttaaccatttcaatattctttcctgagcaaagcataacctacgctttagaacattaattgatttttccttgcaacatcctagggggtctgaagaccaaagcctctttgaagagctcattttaggcaacattggaaacaatttcagaacaccatataggattagttagaaaaccacttggaaacatttggtaactttagttctaccatcatgctgtcacttaggttgaatctacagatttttggatccttctagagcacacatattaaccagctcacagagttatttaagcactaaatgaaactaggtctgtaaaagtactttccaaactaccaacaatatgcaaaggctgcaaaatggtcagatattatttcgtaggatgcttttgcttcctcacagtcccgtcagggttacaagatggatgccatggccaaatgtcacaaactcatatggcagtgtcctaagcaggaaggatgggaggaaggctcctttttatcaggtaggaaaatctttcccagaagccccaactccagcaggtttcccataagtttttgttggctaaaactgggtcacatggtcatccctaagggagggtaatggaataaccaatctcagccaagtggaaacaggatcaccatggttggtttaggccaaaagaacacaaaatggtctgatttaaaggtctgtgatatttaggctccaggtctaagagcctagcttagcttttttgggctcccttacttcctgttccatataaataatttcattttaacactccctagacatactgactatatattctgatgtcccctcttaaatataattatttccccaaagaaactatggcaatctcaaaaaaatcctccagtgtgcctgaactctgctacatgaattcttccatgttcatccctatacttcttgtccatctcgtgcaacatggaattgaagggaaataatgagatttggaatcagatggacctgtgtctgagttgtggctacattgcctcttagtttggttaagttgtggaacttctttgcacttctatttcctcatctgcaaaaggaagacaaaaatattcaacttacagggtttagtacaaggatagaaagtgccaggcgtatagtaggcatccaaaacagatgattcatttatgtttatctttattattatgacacatatccatttctgtgattgctttatctctaaatctggttccaacttttcatttgactcatttgggttggagacttttttttttccatgttctgcttttgttttgttttgtggcttatcctggctttaaccctgtataggtggccctccatatctgtgggcctgcatcctcagattcaaccaacttcagattgaaaatatttagaaaaaaaaataacaatatgaccataaacatacgtttttgtttgtttgtttgtttttttgagacagtatcttgttctatcacccaaattggaatgcactggtgtgaacatgacctcctgggctcaagcgatcctcccaagcagctggaaccacaggcccgtggcaccacacccagctaatttttaaatttttaactttttgcggtaacagagtcttgccatgttgcccaggctggtcttgaacttttggcctcaagccatcttcctgcctcagcctcccaaagtcctgggattacaggcatgagccactaagcccagtgcaagttaaaaaaaaatacagtaaaacaattattgttatagctttcatattgtattaggtattgatatggtttgtctctgtatccccacccaaatctcatcttgaattgtaatccccatgtgttggaggaggggcctggtgggaggtgactgaatcatgggggcagacatgccccttgctattcttatgatagtgaatgagttctcatgagatctggttgttagaaattttctgagtgtagcacttcctgcttcactctctctcttctgctccactatggtaggacatgcttacttcccctccaccttctactgtgactgtaaatttcctgaggcctcccagtcatgtttcctgtcaagactgcagaactatgagtcaaccaaacctcttttcttcataaattacctagacttaggtagttctttatagcagtgtgaaaacagactaataattataagtaatctagaaatgacttaacgtatagagaaggatatatgtacattatatgcaaatagtccaccatttggtataagaaatttgagtgtccacagattttggtatctgcaggggtcctggaacaaattccctgtggatatcaagggacaactgtactctttcaggacatgctcattggttccagtattctgctatttgtctgttgatttcaatacaactctgaatgaaagatgctcagatccctgagccctagtctggaagatacagcaacaataaatgtttgtgaaaatgaaaaaagaaaataaacatagtgaacatattttaaaaagtgcaataaagatcagcaaagtccaactacagtcacaacaaaggctggccatgtcaggaaaaaatatatgcaatatgtattttttacacataaaataagtttttgtgacatctttgaacgtagattcaaacaaaacatttctatatttgtgtgtgtgtgtgtgtgtgtgtgtgtgtgtgtgtatgagagacagagaaagagagaattataaattgcatcaggcaaaatggaaattggtgattctggataaagggtacatgttagctccttgtactgctttagctgctatgttgtatgtttgaaattacataaaaataaaaagcgcttaaaatgcacagacatttcaatgaaatactcacaactgaagtgcgtattgaatatattagagtgggtggcttgggatggtgggagttgagatagagataaaggagaaaaataatgaaataaaaccagagtggggtcttgagatagctgattgatgatggtcgtggagcatgagctagagagaatgatggccttttctctctgcagcaaggtcagaaggggatgatgaagagataggtacaagttccttgtatagagaatagtctggacactcttctgaaatattaacttgggcgtgacttgctgaatctttccctttcccatgtgtgtcaggcaagtagctggactcttgatatttcctgcttcagggattttcatagggcagaaagcaggaacaatttgaaggcaattgtatctcctgtcttttgtaaaagcctaaaccaaatgatcttcagctgaggggtgcatttgaaggtatttagaaagaagagggagagacttcacctagaataaaaaggtcagagaaggaaggagaaatctagggcaggtgggctctggacacagagctcccagccccacagaatagtcgtatgccctaattggaccagaaaagaccatgttcctgggataatgggtatcttaaagatagtcagggtggacagataagtgatggctaggattttctccctgatgttctgtggctgggtaagacactttcagagccctgaggggtgtcttggtaacttacatttcctgccgggataaatagatgggtgttcagacttagatttaatttgattgcagagaacaagagattttctatactcttgaatttgtcaactaaaagtccaacgtgcctcaaacatgtggttctatttacaaaatagccatttacaaagctggtttacaaccatataactgtttgtaatactctgtataatattatgttatcacctgcatcatatgatcattcaataccatctttagcaaaaggacagaggggccacttttatcagttcctcaagaagagagccttggaaatgataaattcttatgaactattgttcaaaaataacccctggttatctttagcctgctccaaatgcccttccctcgcccctcttttttttttaaagaatgtgtcactccagtagatagaggaaatgtgaacctagtataacttctacagtctttagaaagcccagggtaggggacaggcaacagaacaggtaaaggaatggtgttcaagcaactgaccaatgtcatgtttcctaagaaaaattcaaggaaagaaaagggtattttttttttcttcagagtatttaacaattttagaaatatcaattgactcccaactttctttacacaaacaaaaactgaaggaggcagatatccatatctaattcttaggggtaaggcagtgaagaaaaaagaaattaattctataaattggcagaattgaggtgattgaagagaaaacttatattcttgctaaatgagcagctgggtgggaggacaagaaaggaacaaagctagaaagggtagatggaggcagaaaggggcagataaagagctctactgaacaaaaaaggcacatttctctgcatgtttaggaaaaatgcctatatcctggtggaagaagacttaaagaaaaatctggtttataaagtgtcaacaaaggttcagacatgctcgatgtgcttgtgttggcatgtgtgtgctccgtcttttttaagtggtaaattagatctttgtctacaggtaggtgtgtgaagagcagaggaataaaataacgagcccagtgaatgcaagtaatgaagacatctctttctggcagcttttcagcattttgagcttgaacctgacatgacagcctgtcctggcttacctgggattgcttagaatagtgcttcttaaactttcatgtgcatatacatcacttggagtgattaaaaatgcaggttctggttcagtgtgtctgaggtggtgcctgagtttcttcatttccactaatttccaggtgatgccaatgccactcctcctcagaccacattttgaatagcaagggaatggaacacatcatcacaggttcatatatatattcagagatgcaaagtatgtacatacacacatggatttggatacgcttatgggtgcacaaagtcatttgttcatttgtttagacaaattttgagtgtattgttttagggcaggtactgtacacatatagacatacacgctttttaggagtgatctttgcaaatggattttaaaagcacaaacgatttctttgcttccccaaggcattccatcattctctagcatcgatctctacaaatggccttgctctcttactcttagttactagctgactttaggatgggcagctgctgtccgacattatttatgtacgggagatgatcccaatatcctaaggtaatcctctccattgcctgaaattcttaaaattgccataagacatagagatgaaaacatgggtattggaatcaggaggcctgggtttaaatcttgactttgtcactcacaacgcaactttaacctccatgagctccagtttctgcatttgcaatatggtgataataaagtttccctcatgggaatggctactcaccaaattcaacaaatatctattgtaggttgattgcctgcaaaggacacagaaatagagttgattcaatttctcaactgaaggaactcactgcctagcagagaaagcaaagacagaagacgcatgtaaaggaaatagcacgaagaaatggctaacttactttttggtgggactaaaggcttcctggaggaagtgagagctaagttgggctttgaaggatgggaagagttacatggtggaaaaggagagaatcaagtgatacttttcaaatttaatctgcatctaaatcactgaaattgcagattctgactcagcacctgaggtggggcatgtgattctgcatttctaacaagctccagttaacgctgatagtgttggtctctggatccacacttgaagaagcaagcagggcattttaggttaaagaaataccagcacaaaggtgacagtgaaaagccacatggtaggtttgaaggacagcagcagctcaaaatggttgcaccatcaagtgcagggaaggaagtgacactggaaagctggtagagttagagcaagtgagaattacatgaaaagacaaaagtaagtctttctggcacatagtggacactcagaaatggcttatttccatcacccattttactcaaattcccaccaattagaaaggaatagagagaatgtttaatatgaggtggtaagatatttgatttctcacttccatttgaggcctgagtctacttaatttatgaaaattaagtagataaaaagacatctagatggtcatcttacctgcctcagagaaagaaggtgattcccaggctcaaacaggattaagcagaaaccacttcacagagccaaatatcccatcaggacaaaattgttgagagttaaatgggataacatgtacattcctagcatgtcataagtgcttaactagtttctcctactttgagtgaaggaagcctctgtatattacgacttcaatccatgggacggataacttgtattcccatcccaaaatactactcctaatcacttcacattatgaaagttttattaagacttttatctccccaagagggtaacacttgttactctcaatctcccctttataatgaatgcaccttggagcaataaaaagatgctgatggagtatggagataggacaaaccaataagaaagatgtaaaacttacaaataaagaatttcttatttcttcagattgtttcaaaatgctaagatacctttaaaagctttagaaaaatatgatgagtgttctccaaacaacttcacatatatgtagctcactggccctgattacattaattcatcattcattctttcaaagaacatttcattgagcacttagtattgtcaagcattgttctagtcactgaaatacgaagcagaacaaaatagaatctctgactccaaggttctactaataatattgcaggaactctctatagtatttaatttattttgtaaaagaaacaaacagacctaagcaaacacggcaaagcataacaatggtcaattctgtgtgttggtatgtggaatatttgctctagcatttttggtagttttttttaatttttggaatctctcaaaacagtaattgtatttttaaaaatcccctgtatcagtgaactatttatacaataaagctgcataacaaacaattcccacatgcaatcataggtagttgatctaggcttggctttaagggatgactctgtttcaagctgtgtcactggctacacttggcttctcactaaatttggcttgggtctgccctatgtgtgtttgttctggtgcccaggctgaaaggacagcagttacccatgggaagttctttacaaggcagtatggcaatccaactgaacagaacattttaagtctctgcttgcatggtgtctattaatatacatttgcctacaacaattcacttatgtgatcaagcccaatgtcatggggaaggaaagtatactctccctacccactatgagattaaccagtcagatggtcaagcccaacatcagtggaggagggagaacagaaggagtaagcgtgtctttaaaatgtctattatgctctccaaaccagtggaaaaacctgagctaaatatctgagaagattgcaatgagtgaataatgcaaaggtgtgttactctggctagggggaggagaagtgtctgggaagacttcatggaggaggtgatacttgaggaaatgttttccagatatacaagatgggcaatgggtttcatgtaaaagaaacagagtgtacaatgacacagaggcccaaaagagcttgattcatactggaaatcaaaagcaattccttatgaatggaagtgtgagtgtgtgcaaggtgtgcatgtttgttggcggaggagaaatgaggaggttggtgggtttctaaaacagagcagaataacccataaaggcaagcacagtcagttcacaaaaggccttgaacctcataaacaggagtttacattttatccagcaaagacttggggacaattaaaagatttatagcagcaatgtgacttgagatgattgatattttggaaaagcactatggctataaaaggaagaatagactggagggcgatgagtcaggaaagaagaaaattagttaagatgtgattagactggcttcactggcgaattctaccagacatttaaggaaaaattaataccaatcattctcaaatgcgtctgaaaaatagaagaagaggaaacacttcctaacttattctataaggctgtattaccctaataccaaaagccagacaaagacaataaaagaagaaaccaatatcccttatgattatagaagtgaaaatcctgaacaaaatacagacagaagaaatctgagaacatgtaaaaggcttatatactatgacaaagtgaaatttattccaggaatgcaagaatcatccaacataagaaaatcaatcaatttaatacaccacattaatagaataagagaataaaacttcatgatgtggaaaaaagatttgacaaaatccaacattctttcatgaaaaaacactcagaaaactagaaatagaagagaacttcttcaacatgataaaggacacttatgaacagccactgttaacatcatattcaatggtgaaatatcaaaagcttgccccctaagattaggaacaagacaaggatgctgacttttaccattgctattcaacattgtactggaagttctagccagacaattatgaagaaaaatgaaataaaagacatccaaactggaatgaaagacataaaactatctctattcacagatgacatgttcctatttatagaaaatcccaaaggattcatatacagacacacaaaaccccaatcctactagagctactagacttcagctaagttgcaggataaaataacaactaaaaaaaactcagctgtggctgggcacggtggctcacacctgtaatcccagcactttgggaggccaaggtgggcggatcatgaggtcaagagatcgagaccatactggccaacatggtgaaaccccgtctctactaaaaacacaaaaattacccgggcatggtggcattcacctgtagtcccagctgctcgggaggctgaggcaggagaattgcttgtacccaggacgtggaggttgtaagtgagccaagatcgcaccactgtactccagcctggcaacagattgagactccatctcaaaagaaaagaaaaaaatgttttattttttcatccactggaaatgatcaacctgaaaaagaaattaagaaaataattgcatttacaattgcatgcaattgaatataaacacctagaaatgaatctagaatataaaaatgaatataacactagaattttaaatctaaggaggtgaaagacttgtacactgaaaacaacaaaacattgctgaaataaattaaagaacaacataaatggaaagacattccatgttcatgaattggaagataatacagatagtccccaacttacaatggttagacttattgttttttgactttatgatggtgtgaaagttatacgcattcagtatgctcctcaacttacaatgtggttatgtccagagaaatctgtaataagttgaaaatatcataagtcaaaaatgtacttctgacttacaacattttcaggttatgatgggtttatcagaatgtaaccctgttgtaagttgcagagcatctgtattgctaagatggaatactacccaaagcaatctacaaattcaatacaatctctatcaaaattccaatgacttttttttttcagaaacagaaaagttcattctcaaattcacgtagaattgcaaggggctctaaatagctagaataatattgaaaaagaagaatattggaggactcacacttcctgatttcaaagctacagtaattaaaacagcacggtactggcataaaaagaacacacagactagtgaaatagaattggaaagtccaaaaataaacccaggccaggcacggtggctcacacctgtaattgcagcactttgggaggccaaggtatgtagatcatctgaggtcaggagttcaagaccagcctggccaacatggtgaaaccccagctctactaaaaatataaaaattaaccaggtgtgttggtacatgcctgtaatcccagctgctcagtaggctgaggcaggagaatctctggaacccaggaggcagaagttgcagtgagctgagatcatgccactacatgccagcctgggcaatggagtgaggctctgtctcaacaaataaataaataagcccaaatatttatagccaattgattttttgttaagggtgccaacatcgttcaatagcaaaagaatagtctttttaacaaatggtcctgggacaactggatatctacatgcaaaatagtaaagttggacccctacctcacaccctccgaaatatttaaggggcaaggcaagaggagtatatgggaacttgtaatttctgtgaaatttttctgtaaaactaaaactgctctaaaaaataagtataattttaaaaataagacatcaacatggtgaaatcccgtctctactgaaaatacaaaaaaaaaagacatcaatgcacaccactaggatagttcaaattttaaaaagactgacaataacaaatattgaggatttagagcatctaaaaatcttgtacataaacaactaaacctgatgggaagtgaaaatatatgctcactttggaaaacagtttggcagttttttaaaacagttaaacatgtatttaccatatgattcagcaattccactcttggcaatttgtacaagagaaataaagacatatgtccataaaaaggcctattatgaaatgtacatagcaacttcattcacaaaagccaaacattagaaacaaaagtccattgacaagggattggataaacaaattattgtataaacttacaatggaaatactattcggaaataaaaagaaatgaattactgatacatatgacttatatgaatctcaaaagtattacaaatgaaacagccagacacaaacactatgtactatattatttcatttatatgaaattctagaaaaaacaaagctatattgacttaaagcaaattaattcttgccagggaccagggtcagagaggttactgactattataaaaggcaagggaatgtttaatgagtagtgaaaatattctaaattatggttgtggtggtggctaaatgattgttatgcatttgtcaaaatgtgtcaaatcttacacaaaatttggtaaatgttattatatatgaagtatactttcataaagatgatttacaaaagcattattaaaaagtaaaaagtgaaccaatgacttaaacacaagagctaaaactataaaactcttgggaaaataggggtaaatcttcatagccttggatttggcaacagattgttgaatttaacaccaaaagcatgagcaacacaagaaaaaatttaataaattggatttcatcaaaattaaaaacttttttgcatcaaatgatattattaagaaagtgaaaagacaacctataggatgggagaaaatatttgtaaatcatatatctgataagggcctagtatccagaatagataaagaatcattataattcaacagtaacaacaagaacaacaaaactcaatttaaaaataggcaaaggacttaaatagaaatttcttcccaaaagatatacaaatgaccaataagcgcatgaaaagatgctcaacatcattaaggaaatacaagtaaaaactacagagggataccacttcacacccactaggctagctataatcaaaaactagaaaataagtataagtgaaaatgtggagaaattggaacccttgtacattgctggtgggaataatgtacaaaccaataatatattgtttggttgctgtacaaaactggccgttcctcaaaaagttaagtataggatgaccctatataggacctagcaattccatctctaggtatgtaatcctaaaagaactgcaagcaagcacttagcaaatacatgtacactcatgttaataacagcattattcacaataaccaaaagatggaaagaacccaaatgtccatcagcagataaatggataaacaaattgtggtatatatatatccaatgtaatattattcagccacaaaaaggaatgaggtactgacgtatgttacagtatgaaggagcctagaaaacactacgttatatgaaagaagcaagacatgaaagattacatattgtatgattccatttatacaaattatcttgtaaatctatagagacagaaagcagattggtagttgcccgaggctgggggagggggaaacaggaagtaactacttaatgggtatagatttacttttggggtgataataatgtgttggaattagatagaggtggtagttgcacaatattgtgattgtactaaatgccattgaaatgttcagtttaaaatggttaatattatgtcaatttcaactcagttaagaaataaaaaggatactgttggtgctgatgaaaaataatgagcttgaactcaagcagaggccatgacaaaggagtcaaagaagcagaacaggagaatggtaatagacagtggagggtggaagggggagtaaagggtgatgctgaaactcctcgtgtggaagagctgatgctctgttgatatagattggaatgtggaaggaagatggggtttggagtgtgggggacaacgagtttagttgggtcatgagggttggaggtacctgtggaggtgtgcgggtagagaggtctcactgtcgggtggacctctttgccactggaatataatgggagagaagagctatacgataccttggcagacagaccttattagcaaaattctcttctgaatgaaaatattgataaaacaagaagtcactaaattcctaccttcctattactgtgacacaagtccttttagtaaattaatttttgccattttaagtgattagtgaggattgagtattatataatattaaggattcatctaggaacatatagcaaatctattccagagccaaaatctgtccaatgctcacactttcaccattcctgcttaaatgccccacttaccaggttccacttcaccactgacggcagcatttggctccttggtctcctgaggaaatgtatccattttccaaaaagtctccaattccagataattagctggaacaggtatattggtatcttaaagccagaatgaagtcattgctctgaggaaactgttagcctgataatcctgcatcacacatcagtattctctgtttcttttggccacttttattgcctgttttcatccagttatcacgcttccccaaagaaaactgaagccaccaatccttacatagaggaaacatttccttcgctgtaggagcactgaaccagcgacacccatctctaaattgttaccactcctcatcttgtgttcgtgccctataagcttaaaacttggaatttattagaaatgtcaattgcattgaaaacaaaaacacttttgtaaaagtatgctaaaggcattcaagaattgaggaagaaattatgactgctgtggaaatagttccttattcacatctggaaaacatttgctaggggcacaaggagggatggatgaactgcaggtatgcataggaatttagggtttttttccttttttcttaaactgccttctctcctaccacccctttggctcctccttagtcttcccagacaagctaccttgcaaatctgcccttgcaaagttctcccattccaatttaattccctctcctcttttgtagatgattttgagccacacagccccagatggtcagtctgggaacagacacaggctttttcaaagagacaatattgattccctctagacccacaatgacctctttcttctagctcttcttactccagttcacaaggcttttaatccccactgaacacaacacttcaatatgggtcagaggatgggccacaactcaaaatcaactgttccaatccaggaagtttcgactggcacaatcagcgttccattaagcagggtctggtgccattgttttttacaaggctctcaccagctggccttgctatgcttggctaagaattagacaagggagggaggatctggcttgaataggaagagagacaaggctggcttttaaaggtgacaccctaaggacaagcttgaagggacagggaataggcaatgtctctcacagaggtggttctgcttttgtggaagtaccaatgcaggcaggagagaaacacgttgacacacacatatcaggctctgaaacaaaaccaagatcagaagaacactgaatccactcagtccaaatcacacactcccctttcactccagatctaaggaaaacctcctaggaggacataaaacataaacattttggttaaaactttagttttcaccataggcttgtgccacgcaaagatgctcacagacattagattttcttttaggaagctaactttcttaagtgtgtgaagtgtcatttatccagcagcagagaaataaaagatgtcctacttacaaattctgtggtttgctggcataccaacattgtaaaaatgtaaacaatgctacatgaaaaattttataaaaatatattttaatcatagatgttaataataaatatgtatttacattattccatgtgtgtttggtaagtagagttcattaaccataataactttatataaggagagaatattataaatggttttgatcatgagctccagaatcattagaactctgtcactcactaagtaccttggaagagtctcttagtctctataagcttcatttttctcatttttaaaatgagagggaggtgataatactacaatgagaatgagtcgctcttaacataaaaaatacttaacataatgctgacacatcataagcacttactaaaaaacatgagtgcactactattactaatttttgatgatcatcataaagaatgtcagttatgacacctagtccagtcagtccttttagataagagtttgttaaagtggatgtgaattccatagtgttcttaggttatgctttatactaagtgatctgtcactattcctggtcctccctgtttcttagcctttgcttcttaccatggtatcttatagttcttcccttgctgcttttaatctgatccctctgtcaactaagaagaactttccctctctcccttctcttgcaaaggaacctagacaactacatgggtcaagtcagtagatttacatttccacccaattccaaataagcatgctaacccttcaagatgttcttgtacagaaaagtgcatgggctttgtaacgataagttctttcaagctgcataatggtctcttggagtgaggacatttccactatagaagcaggtaatagcactatgcagagagggaatggacagcacaaaatcatagagacaggtaagtgcctagaatgtcagagaaaagttagaatttcctgtggctaaaacataggtggctgggaaaaggctgtgaaatgatgagactggtgagctagggctcagttctttagagttatgtataagactaaaagaatgactaaaattataaacattttcaatattttaggtattgtgttaagtgttgtgcctgcattatctcatttaatcatcaccataatcctgtaaaatttgtaacataattatgcccattttatagatgaggaaactggggcttaggaggattaaatcagtgtcttagggcctatacaaaactgtagtagtctcccccttatccatggttttgctttccatggtttaggttacccatggtcacctacggtcagaagatatcaaatgaggctgggcacggtggctcgtacctctaatccctgcactttgggaggccaaggtgggtggatcacgaggtcaagagttcgagaccatcctggccaacatggtgaaaccccgtctctactaaaatacaaaaaaattagccgggcatggtggcgggcacctgtagtcccagctacttgggaggatgaggcaggggaatcacttgaacctgggaggcagaggttgcagtgagaagagatcacaccactgcactccagcctggcgacagagcaagactccacctaaaaaaacaaaaaaaaaaaaacaaaacaaaaaaaaaaaaggaaaagaaaaagaaaatatcaaatgaaaaattccataaacaattcatataccttaaattgcatgtcattctgagtagcataatgaaatcttatgctggccctctccatccatcctgcccaggacataagtcatcgctttatccagtggatccacgttgaatatgctacctgcctattgttacctagtagctgtcttggttatcaaaaaaaaaaaaatagtatcaatagggttccgtgctgtattagggttctctagagggacaggactaataggatatatatatatatgtatgtatatgtatgtattatatatactatatatgtatgtatatgtatgtattatatatgtgtgtatacatatatacatacacacacacatatatacacacatacatacatacatacatacatacatacatatatgaaaaggagtttattaaggagtattgactcacaggatcacaaggtgaagtcccacaataggccatctgcaagctgaggagcaaggaagccagtccaagacccaaaacctcaaaagtaaggaagccgacagtgcagccttcagtctgtggctgaaggcccaagagcccctagcaagccactggtgtaagtccaagagtccaaaagctgaagaacttggagtctgatgttcgagggcaggaagcatccagcatgggagaaagacaaaggccagaagactcagccagtctagtccttccatgttcttctgcctgcttttatcctagctgctgattagatggtgcctacccagattgaaggtgggtctgcctctcccagtccactgattcaaatgttaatctcctttggcaacacctcacagacacacccgggaacaatactttgcatccttcaatccaatcaagttgacaatattaaccatcacaaatactatccatggtttcaggaattctctgggtgccttgaaacatatctaccatatataaggcaggactactgtatttggttccaaatgctatgcttataactaccatcctatactgtcctaagaattagtctgtggtaataattttcactcattgtatgggcaatggggagacaggagaggttttaagtgaaaaagcaatatgatgagatttatttttcggaaaataagtcagtggttgattatagaggagagaaactgaaagcagggagaacagtctagacattcaaaatagacatgagcaagacttaaactgagtcttgacagtggagatggagaggagggcagagaccctagagacatttcccaggtaaaagcaacaggacttggggactggatggatgagggaaaaggagaagtaaagtaagtcacccaagtttttagactgctgaatgagtgaatggtatgcttcaaccatctatgttggggcagcatgtcttattctgtcctctaggaaatagaaatattaatgttatcacttaaaaaggggcatgttatcatacatgattggattaaacagcattgtttaatacaggacttgtcaacatctttaaaagctttgtgtattgagaatctccaagagaacaactctgtatataccggggggatgtccaataggcttggtcatataggtctgaggctcaagaggaatacctagaggtagaggtttggggcttattttcttcagcagcagatctttgatgacagcatttctgtattttccaccatgtctgtttgcttgctatgtgttgcttattgaagatatttttacaattctaaaactgatggctatgcatcatgagttgaaaatgcaatgtggatgagaactaaaatatatctacctctgggtgaaaccaaatcattttatatacaaacaatttaccgttccattcaaattggctagtctttggaaccactgaaataaactgttcattaactgattaaaaacatctgagataagatttgattaattattttatgtgcttctgcaagaatctggggaatcttggacttcactggagcataggttcagattaaattcatctcagttgactgggtacttactcatctcataggaaaaaatcactcatgccactgttagtagcatcacatcagtcctctgcacattggcagaaatatgctcccagctgcacaagtatgtggtttctctgatcatacagtaaatgtacttgtgaccttaaataacccacaagggtgtgaatgtcagagctgggaatcccttcctgggaaccgcaggacaatctgtcgacctatcatttttcatcagtgtggggtagattaactcttgctatcaaagtcctaccaaaacatctagtgccaccatggctcagtcagtggtagccaacaaactaatgtcagccttatttttttcattcttattctactcaaaccttaacccatagagagaagtgctctgtacgctttatagatattaaccttcaaccccataaggtagcatcataattgaccctatttagtaaatgagggagatgaggtacagaaagatgaatgcagttgcccaagatcacagagcctcacatagcagaatgattctttccatccacagggcatctgaaaatggatcatattataatacttccagcagaatttcccgagcttcgttcacatactgcatatccacatgctagctttaatagtatttatttactgtatttaaaaaatcaatacactttaaaaactttagcttttgtccaaagaatagaatatataaactcacagcattgatgtggcagttaaatctttcctctaaaccacaagaaaatgggctcatggctattttaaatttttgtctttcctaaaatttattttataaccatctatggatgctcacttttcctctgagcagcttacaccataaactagaaagttattcattccgaacattaaatatgtgcagtcattcaacacggttaacatttatagagtacctgctactatgttcagggcagcgtgccacattaattcttcattccacatctcctcctccgtgaagctaaacctgataagcagagcccacacagagttctaccccatcttggtctgagagtgtgcaggagataattgagcatttcgtggtcctgttctattccctaactatgtcttctctcccaggaaaatgttagtccctcgagaatattaccattaaatctcccattaccactagtaacagagccttgaacttcatgctagtgattgaaaacacaatcattaatgcccatggtgaaaacagtcagatctaaaaacaggaagagaaggagaaacacccagttattgagaccccactattgctgagcatccttccatcattatcttactcgtttgtaattaatcttcacagcagccgtgtgtactaggaaactgaggtaaagatagaccaagtagattgcagaagttcacatagctggcaggtggcagagctgggattagaatggtgatctgcctggctccaggtgagctgctgtttccattgcaacaggctgctgcacctgcttctagtggaaaagaacacattaaatggagtgatgacaatctccttcgtcagggaaagacactgcaaagtctcattatctcagctgtcctctgctgccaattgctaaattttaaggcaataacaaactgtgaccattggcaaaaaacaaaaacaaaacaaaaaaaacaaactatggaaagacagccttagcatgaataaccagggtaattacccatgcacacaataaattctgtgggcaagagtcctgaccaagctctcaccctcctttctgagtcatacaaattcctgactagaacactgccaattggtttatgtcccaatgtgttgggcacctgtgggtctagcagctgcaaggtttttcacgttcgctcattcacagtagtttaacaagtcatgcctaagaggaattgaggaccaggctcttgactctgttgaagcatcacttaccactctcagattgagagccaggagttggcatgctatgagggaatgcccaagttggcaagcagagtggcttcccaaggacctctgagggcctctgcatatgtgaggatcggacatgggctgccatctacttccctgaagatagtgtggcttcatgcaccggtcctcaacaactctctacagcaccctgagctccttcctttagtctgccctagaaccagcttatgctattgaagcctttgcacactctgcagagacatacttcactgagaggtctcttccaatgtaccaatatacagagtgagcgggtgggatttgagaagtctgttttccagagaatggagatatcactaattaaaaatgactaaaacaacaccctttaccttaaaatgtcatggacattgaatttcagtaggaggaaatgccatggcgatttaatttggcggatggtgaggggatttaacccctgtggtagttaatatctcaggccttttttttttttctccatagaaggataattatttcccttaagtaggaatatgatagggattgaggattgaaatctggtacataaacttgcaacaaatattggctccttttttcctctttcttctttcacgcgtatcttttagacttaaaaatcatatctcaatttaaaaattaaaatattaatcaattcaacattaaacttttccctcatgacttctattttagaaatatgttcatccttcagtctcttttataacacacatgccacagaggtaaagagagcgtggaggttatgtgtgggtgccttagaatgtcctggctctggggaaggaaagaaaaacagaactttattcccagagtacactcatcctatgagccacaggacttaggctgtgatggggccatgtgagaatacctgaggaccagggtctttttcataagaacactagatattttgagccaactccctcctactagcaaggagaggttaagaatgatcataactaatgttcatttaggtaccagacattctttgaagcatttaacacatttaaactctttgaccttctttacagaaatattattctgctataatctttactgtagacatgaggaatttgaggcacagagcagttagctagttagttcaagatcatccagttgataagtgagggagcccatatgcaaatctaggcagtgcaccccagcatctagccctcaatcactcaccatttcctgatgttcaacagatggggcaggcatcatgtgcttagtcaaggcagcctggcctaggcccctctcctctttagagatgaacatgcatacacactgctgagctaacttcttagaggctatctggggagaaaggtagactggattctttgggtaaagtaaagggaaggttggaagagaaccactactttcaacctttttaagaagatgcatgcttcaagacaggtgtttcagagacatagagctagaagagtaaaattagcaaagatgcttgtaactgtgcatgcatgaactatgtaaggagcatggggtgtcagatagggtaaagttgggaaagaaatatggtgctgtgaagaaaaggctggcttcagatttcagagaattttctttgcatcaaagggtttgattttactgttcagggtaatgcttcaccaacttttctattctgttttaggagagtgattgaatattttcataagtcctggggcatggtcagaagccagtgactcctgtgaaattcctctgaaataccatatttagtctctaatatttgagtcgattatgtgttccactccgtaacatatttatatttgttaatatatgaatacatcacattcatcactcttggcgttaaagaagatccatcaatgccaggtgcggtggcttatgcctgtaatcccacactttgggaggctgaggtgcgtggatcacctgaggtcaggagttcaagaccagcctggccaacatggtgaaatcctgtctctactaaaaaaatacaaaactaagccaggcatgctggcaggtgcctggaatcccagctactcaggaggttgagggaggagaatcgcttgaacctgggaggtggaggttgcagtgagccgagatggtgccactgcaccactccagcctgggtgacaagagtgagactccgtctcaaaaaaaaaaaaaaaaaaaaaaggagatccatcatgattatcctatgccttcacaccctccataacgagtaacaccttaccccaagtggtacgtttccctggtttgagaattgtagctctagttataaggagccattagaaggtattaaactaagtagcaacattattagatttgaattttagaaagcgctcagtggtaaaagcatggagaatgaagtaaaggagaacaagacaaaagagagggagacaacgagttgggagactgtccattattgcaggcaaaagatggtgaaaaaaaaaaggcaaaaaaagcaaacaatttgctgagctcttcaactaggcatgcttcttgagaataattacgagagagagcacagagcattttcctcaagacaagaagagagatttagaacttagtcatcacaattttactgtttcttcttaataatttttggaatctggtcttggtgctagatttgcaataatcagactaggtgtgagtttagggaaccagcaaagcaggggcacagaaagaaagagaaagagaaagagagaaattagaataaagataattccagtacccatttaagctttatgtcacctcaaaaagtaagtttactttacagtttgatacaactttgattttgactttcatatggaagtggacgtaccatattagtttaggtcatgataccttttacattcttaagctattccttggagtgaggaactgaggtccccatttgtgagcccaagaagatcagaggaggtggtcaggatcattcagcacactctcagcaagtgtcagactcacccaacaacagaaagggaaaccccagtcacagatccactattatagaaggggagaggtaaacagagagaatttactgagtggttagaaatgattccactcatgaaaaaacaggcgtacaacagcagctaggagtgagcaagacaaactccagtcttcagaattacacacagattcagctctgttgagatcttacttgatgacatggttggactcaggcaacacattttatttgccaatgaaactgtatttggataaatagttaatttgcctgtgtccctcactgcaaaagagaagctcttatttccttctcagtttgaatcagatttgaatcagaattttatcaatagaagattcagcattaattttctctggctctttccaataggccctcctagttactatctcttagttcatacctggcatccttatatttttgggaaaaaagccaatactattaaggataagccatacaataataaaaattatattaataataatgcatctctcactatttagcacttactctgtgccggaagctgtggtaagtaatttacattcattgtctcaattggtcttcacaatgaaacaacaaaatctgtaattatcattttctccattttagagatgggagattgagatttagacatggcagggctaggattcaaactctggcagatgaactctgagtgtgcccctcttcagaaatgggtcttccattcagacccattcaggggttaactcagcctgaactcgcccacacataccctgttttgagctcaacttccttctggcagcagtacttcctgaagcctgtcaatgattcacttccgggtcacctctaccctctgtgagccttgtgagacattttaaatgccagagccacattcattcattgtagctccagcatttcttttcctagggacatgctattttcattaggattaaaacagcccccagcaataaatattaaaaacctgcccagtgaaaagagcagcttcctcagaagcttatgaggattagaatttttaagcaggccccgcttcctatgaccacccctcttctccatccctttgtgtgctcccacatgggtgtgctttcagcatcaatcagatttgctgttttgctcaaatccgttcatactaattgtctgcccatattgctgtgtgctctggacagaatggtctgggagaaatagaaactcactccttctcccacccctggggggattcagattttgtgtgcttgatctttgttggtggcaagataaaaatgcttgctatacatagcagctttcctccttcatgttcaacggcagccctgatgatgggggacctcagccatcctatttgttctaaagccacccacagaagaatcagaccagcagaagccagaaataagctagctggggctgcaagtctctttgtgtgtggtgatatagcagagagacttgggaaagtcaattattttcagtatgagttttggttccactgcttcatggtgtaagatggggatccccaatttgttcatctgtaaaatgaagatgctaatgcctacccactggggctattgggagaattaaagacctatataaagtgtttagtgcaagacttggagcagggagccacggctttgcctgtcactccttcgcctccctggctggaagcctgagtagtaggtgaggcatttattatccatgttcattaacatccctgaagacttgtggttcctgtattgaaaaccacactgagtgttcccagttaattgggtgtccttgggcctgagtttctctacacaaatatatgagcttgggatttttaaaaagtatacagtaattatattcttggacaaatggtaccttttctagaaaagcacagagaattctttcagcactcagggctaggtaggaattgcttgatgtatgggtagcaactcatagtaactaatgatttacaataaatactccaacaaagaaaagtctgagtaaactctatatttcatcctcatggcaatgagctacaaaaggtttgcattttaaatcaactggtggttgtaccccagaaggatgtggtctaaatagatttgtgtgacagggtaattactcatcacggaaaggatcccagctgtcatcatggtttctcactaagcagtcagtgagtgagcagttatggaattacagggctgacctcctgtgtcctgccttacagtcatcctgagccagagtcacagagtttcatcagggggacccaggaggcacaaagcagtcaacacccatggctgagaatcaaagtctagaaggggcctgttttcaacctcttcatccgggtcactggtggcaattttgccaagtgactaaagagctagactaggagttccccagttcagggtcttaatggcctgaatgttcaagacagtgtggagaggttcagagactgcagtctttggggttacacagacctgtgctggagtctcagtctttggggttacacagacctgtgctgctgctcactttgtgatcgatctgcaactaaaaaaccacatttctctgatttactatttttctagctgtaaaatggaggtaataattcctactttaaaagattttaaactagtatgtatggaaatggttggcacttaatgaacattattatttcaccttttgaagtaccattaggtgccagaaactgtgctaagcatattacatggactttgctcataacagttccctattttatggataaggaattggaggaatcttgcccaagtagctagtatgcagctagttagtagcagagacagaatttgacctaggcaggttggatccagactgccctataatcatcagagggtgaaaacataccttcaactggagtttcagagacttttgtgccagttcttgataaacattgtataggtataaactctatcttcaaaaagtttatccagtctcattggaggacaagggagaaacatcagaacacaaacggccctgagaatagaccacctggcaacaaacaataactgctgtaggagctcagtgaagatcaggaactcacgacacatggatctcttctcccgcagtctccatatctgccacatttttttgcactggagtttcttatgtgtcagtgttatataattttaaggctctgattttgaactaaagaatggaccccagttttgccttaagcataaagacaggaaatatacatgccctagagactaagttaacagtaaaatgtgagactgttcctcctctatacacagagaaaactttcatgggaaaaacaggatcactgttgagacagaaaagttatgtatgagagggtgtggaggacggaaggaggcaggaagcataacttggaattattgctttttaagcttagaagggtcatctgaccctaatggatagtaagatgaatattatcttggtatccaagagcaaagatcacgttttgaggccctttctctccccatccattgctctaatgggcccaccctcactttaaaaataaacaatcaaatgcaaacgtggcagttgcattttgtgggccacaaaggagaaagttaaagcctggaggatcagcacttcgtttctgatggcagagcctgcattgtccctgctgcgccacacatcctgtcctcttagatccagcaatgagtgggctgaggataggagggagtgtgcatccaccttcctgcaaagctgcaggtttacctgtggagagtgctctgcatgcctcacaacgcaccctctcaccctcctggcactctattttggctcaggtctgcatggagagaagggaactgtcctgcggaagaaatctggaagggggttaagcctagcaggaaggggaagaagccaaggcaaccaattaattttcctttgctgcttaaatcattctcgcccaatctgctgagctgagaataagcataactgtccccaaggtgtcaaggccctgccttttttgggtaaatcacatgggaatcaaaaatagaaccactgtgaaaaaaggcgtctcagtccaccctccactggcaatggctgagtttggtggatattcatctctattccatgtcatccgccaactttgaggcctgcttgccacatcaccaaagaggttgctaagcatcttcctaccgagtctttaagatttgttacatggatttgggcattatacagacatgtcttttatttatgatgcctctggttaaaggttgcctctcccaaagaaaaaaagcttcacaaagcaacacctactttgatccagcactaaaatatttagtagagtgctatctcccaaaatgtgtttattgaaacatcagttctgtgatatattcccagaaaaatgtacttcatggaaaatatgtaagtccacataagaatactaaaggtaagaatactgtttatgtgagtttaatacagcatttctaaaatttatttattgatagaattcttttgattttcaaaagtttgaggcagtcctcagggctgaggactaaagccctgctttagtggaacatacttaggtaaatgctgatgaatccacaaggattgttttagtaccaccacctctggtgcagagacaagcattctgcttgtcaccacaagatttcaacatcggaagagtaatagtaataccaatagcactaccatttcaccccaactctgtgtctacgtaggctgttgagccagcactgatgtaccagtagttgaaaggtgtctctgagcaatgcacaaaaggctgccatgttagaaaaatgattagcactttattctaccaaaaggcttactgcaagctacaaaccttttttttttttttttttcagtaacaattattagtttggtacccttttgaaaagataatagcataacaccaggaaaatctactcagggtataatcaggcataagcacaaaaggagtgtcactgcacttactgttaaaacaaactcaggtacccttattagacccattttgtagatgagtaaactgaagataacatacttcaatgtcccactgctggtacatcacagagttaggacttgaactcaggcaatcatagttgagagctcactctcttaaccacagatgggacaggtaaatgatggaaactccagactggtgcactcacagtgactgtcaccaaggaggtcacagaagtttctggtttgtcttcttccatatatagaacagccaaacacttctggatttttcctccctccttgcccactgcccatgtctggtggtttcaggaggggacaacagcagggctggctgtattccacataacagggtttttcttagctgtagcctccacacacatcctccacctacctgtagggctgactctacggatgtacaaccaatacattcacaaatggccccgtgtttagatggctctgtgcttggtttaatggtctgttgtcagcatcctgaaattcttaatagctttcgaaaaggggacctgtactaggccccataaatgataaatctggttctgcctgcctatttggcattcattttgtttgttgaattagatatggtggtgagggaaggattttgtgtaacaaatctatatgagaggattcccccaaaatgtataaagaatggtcactgcagataatatatggcaactaaccaaacacttgaacacgtaacacacttatacaaaactatgcccatgaccacaggcaaaatgatgcttgtaagactctaatccagcaattagccacatagccacatatccacaagtcagccaaaatccactcttgttttctctgtcgatatggtgagcatgctattgtcagagagaaatgcaccactgtaggagaaactacttcgtcttatgagatttgatttagaaatttcaagctatcaaaatgttcctacattttggtacagtagtcctactttggggaatttagactcaggaaatcctttttttttaaagtatgaaccctcatattccttgaggtattagtaagaagacaagagaaaaccccccaaatgttcaaaaacggggtatgattaaataaattatagattccacttgatagaatgaatgtcaggggttggcatttaaagggccaggcagtaaatactttatgcttgtgggtcatagggtttctgtcacaactactagctctgctgttgtagcatgaaagcagccatgggcaatacaaaaatgaatggatgtagctgtattccaataaaactttatttataaaaacaggtagtggaccagatttgactggcaagaagtagcttgccaatgcctagtactatcatttaaatggtgattatgaagactgcctgaatgtgggatgtttaacgaaaaaaaaaaaaaacaggataaaaacttgtgtgaccataatgattacaactgcatatatgtatatgtctatgtgtatagaaaaatctggggaaaaaaccttacatatatgtaattagttgggctagagtgctaggattctgggtaattttcttttctttgccctgagagagattttctcagccttgatattctttcacatacagaatactgactatgtataaaacaggtatagacacagaccccttctaatgagtaccagctaacaagcacctaatagatgataagggagcatgggctgcactcatgcaatcgccatttgcttcataacctttgcttcccaaatacttagcctcctacctttggaggtttccttccattggcctaacaccagacatgggcaggacatttttgttgaccggtgttcagctgggcctatgaccactctgttggtcaggcttttccagggaagctggtcataaaacagcagctgagcacctgcagtgggaagagtggggaaagagaagtgacattgtgacattctttaagaggaaaaagtatagtcctaactatcttatcatgaatccatccagttaataacagaatataggctgccataaatttgtgtatgagactacctgcctaaagactctcattttgttttattgaacaatgggatgatctccattagtggatttcaccatatacagatgtagtaaaaatcattaatatatttaaatttgttgagctggagttttataagggattttttccttgaggaaattgatttggttttgtatatgtgttcatggcaatatgatatatcttgtctcattaaattcaaagaatgaaggattataacaaaacaaagtaggcactgcttttatgaagcatgcccaacaatgtgctgtgaagatgatgatttttttttttcttcctttgggatttcataattgaacctgagttgatgtaaagaggagatttctgaatgaggaaaacttgaaaacaatatcactttttttgaaaaaaaagaagcatctgttttctttatccttgaagtatctgatactaaataagagattttctctttattgctccagtctattggttatcacaatgaaataatttcctaaaccatacctttgttactggttgtcagcgaaatagttatgctatgtccaaatatgggcattaaaacttaacatcaaatccatagaaaggagggtgtctagagaaaagtgtctttaattgtaatctacatgcacctgataatcacctcaaaaattaattaataattaccattcactttatccataattaatcacaaagtcaagcaaattggaaagccctttttcatttgaacaaattgttggacttgggaaattatcccatagcaagaactggggcaaagatgactaacctcctggcaatcctaaaagtgtttaaggaatcaaaataattaaaaaaacaaattttgagggcttactctgtgtctaatattgtgctgaggactttacatatgttagcttgtttaatcttcacagtggcctaaggaatagacgctgatattgtacccattttacagatgaggaaatacacaataagattaagtatcttgcttaagatcacaaagttactacattgctgagcaaagacttgaactcaagtttctgagactctaaaatttcattttttacctagttcattatactgccaaaccaaagggaaggttctaaaggatgaggtggggtggggtgggacagggtatttcttaagtgcatcaagggagggttctcccaggaagttctattagatgtaaatggagaaaaataattttacattgtttgtagaacatgaaattatgctgaagccaaaggccagtgatttaaccaggtgctaaagagagcatgtaaatgggaaaatcatgaatagtcaaaaataatcaagaactccgagatcccattccctactccattaaaaaaaaaaaaagacagaaaagaaacaagtttatttgtcatatgaaaataacccaaagtgagggtagggcatagggtcagctgatagccagcatatcagtacctccttttaggaaatttgtatatatattctgtcataccacatatatatgcttatgtacacacaaacatagtcacatattaaaatacccaatttatctggcttaataagaaactacatgatatacatagtagaatacaatatatacacatagtatgttaattaatcaagaatatattttatatatacctacttttcatatttatatattaatatgtaattaaatttaaaaattaagcaaataaaaatgtattctaaatttatctactttctatatttccatattcatgttattaaatactaatttaatatgcaattaaatgtatattaattgctcagagtattcatcagaaacatgaagggtagtgggtgaggggaggggggatggttaatgggtacaaaatataactagatagaatgaataagatctagtatttgatagcacaacaagatgactacagtcaaaaataatttattgtacatttttaaataactaagagtataattggatgtttgtaacacaaaaaaggataaatgcttgaggggatgaatagccatttatctggctgtgattattaagcattgcatgcctgtatcaaaatatctcatataccccataaatatacaaaactactatgtacccacaaaaattaaaaaataaaaataaaaatattctgttcaaaattcatgactttagacctcatcaaggcctagggaattctctgtctctccattacatgacaccagactaccatgctctttgaaatctaaagtctgaaattttaggggcagtctatacagtatcaagaaaaatcgtgtatgccttggtactacaaagatctggaattgactcccaactgtgtgttcctgtgtaagttgcttaagttttgcaagcctaactttttttatttataaaatgggtacacagtgcttgccttcctaaaagcattactgtgaggataaaagaaaatacatatcaaggacctataacaaaagtgagtgctcagtaagtagaaattatttttactacatcactgtttgtgtcaacatccttgctttctactgtgggtgttgctttctctagtaaaatcccaactcttaattagctgactgtatcatgctaaggactggtaaatcagatgacagctgataaagtttactagaattatgcccacagtaagaataaatgggctctgagcaaataaaaaacagttttcacaagatcaattttgactgttgaaaatcagactccctgctgcagtgctctgttctagaatcttgaaaagagatgtaataggtttcatcttctgtgccaacagtgatctcttggaagtggctgctggtaatgctgggttgaaaaggattctgcacctgagtcctactttagggtgaaaaggtgcattgattaactggtaatgtctgccttggcaagggaagggggtggggtaatttgtgtgacatatgcgccccatgttttctaagtctaatctaggttctcaggctctccaaatcagttacctttatataaatggtgtatacatgtgtgaatatatatgtatataaattcatatacataaatccatataggtgtttataaatccatttatgagtatataaagtaactactttattgaaaaatctgaatgcaatggggatttcaacatgaaactattttatgtttcactaatcactcttctcaacagttacatcagaagtccctttgggcatattccattagtttctgttaaatttagttatttaaaatagaattagttcagcacagttttaaagtctaatcccaaaactattataaatctcctgtcctcttctgcagcacaagcttgatgtgtattttaagagacttgcacaggtgagggcaagtgggcttctcttttaattcttcttactcctctcttttttttttttttttttttttttttttttttttttgacagagcctcactctgttgcccaggctggagtgaagtggcatgatctcggttcactgcaatacccacctcctgggttcaagcgattctcctgcctcagtcccccgagtagctgagactacaggtgcgcaccaccatgcccaggtaatttttctatttttaatagagacggggttttgccacattggccaggctggtcttgaactcctgacctcaagtgatccacccacctcagcctcccaaagtgctgagattacaggcttaagccactgcgcctggcccctcttccctctcttaagcctgactctgggctatgtcctctccccacccctatccacttgtgggtctctgtatcctttgggaagaggagctgggaggggaacaagggagaggatgaggtgtctcgctggctgtctacagaggtgtctttggactcactctgtcttcgcctggctctgtctgccactggtgacttctgtacatggatattctctattggttttagaggatggtggtgaacttcactctacttcttcattgctgaaggataactgtatctacatttgtctcccaccacagttccatacttccaaccccctttccagatgaggcaactctcactacatagccaccttggcagctccatgacttctgcttcctgtactggtgccctggagaaatcctcttatattccctaaaaggtagagtgtgctcccatcttcttcccaggaatatgacatctttgtagtccagcctgctatcttcagagactctaggaaagaagcagcctctagactctatattcactcatgccccaaattccaaattccagaggttgcattgagttctcccacttactccacttccatcctctactctaccccactggcagcactcagggccttcagtttcccagttcagaagaacatgcagagagtgatgttggcaagacgggaagaataggagttctccggcttcactctcccccacagaaatccaactggcaactgtccacaggcaagaataccatcctgaatatccaagaactcaggagtgaggctgagacacccccttagactgcagaactgaaaaaagctatgattcaatggtaagagaaatggttctcattgagcatactcctccttccttaagctagcatagtgccatgcacaaagaattctggactcatggtttctatagtgggaaaagtgagttggaggtggacattcagcctccccaccattctgggaccctgtgaaagaggctcactccagtctcatcctatgggaaacactgagagtaacagcagggctataccacctggggtcagttagaaataaagaatgggggtgtttagctactctggaggctgaggcatgagaatcacttgaacccagaaggcagaggttttagtgagctgagattgggttgctgcattctagcctgggtgacagactgaactctgtctcaaaaaaaaaaaaaaaaaaaaaagcgggcgggtgatagagttcacagcaaccatcacacaaatcttggtagttgctctgaactttggccaatggagcaatggaggtgccacatcagagaaactacccaatagcatcacactacagaaaacatggtccacaggtcctttagcattgaatccctagccagcttctccacacagcccaagtgctctccctaagtcttccctaggtcgagaggcaactgtaggtcagtaatgaccagagaaaggaacatctgtccctgtccaatgctagtagtggagaggtaacccaactaagccctggttctcacattaagcctttcccaagtcaggaggcaaccggcaattacctggggagggagcatctggccctgcccaactccagctgcagcatgattactcaaccaaacctcagtgttctggttaagcttcctctaggccagcaggcaagcccatacccacacatatctgtggagcagagcctgtggccctgcccaccttgtgtggccaaacaacaagcccagagacctcactcaaccttggagtccattgcatggccatgctgaaccacaaattccaaacaataatactgtctagccagggaagacaaactgcaaccctgcccaatcagatataatttcagtgcccagccagcggcgctccacctgatttcagagtccagccagtggtctcgctgaatcacagagcacaatcagcaataccattctccctcagaacacaagaagcaacccagcccaacttgagaaactgacagcaaagtctgcatgctcagcgttgccaccagccaactcatccacaatcccaggctagactaaataataaaggtgtttcaccaccaaagaacacctgcaaaagccaggagaggtggccttctcctcaaataagcaaggatcagtgtaagaatacaaacaatatgaaaaattagggaattattgcaccaccaaaagaaactaataaagctctgctaatggatgcagaagaaatgaagatctataaaatggctgacatataattcagaataatcctcttgaagaagttcagggaaccataaaaaaatatggatacaaaattaagtaaaatttggaaaacaattcatgaacaaaatgagaagttagacactacatcaataaaaaaataaattatagagataaatacaaaaactgaactgaaaaattcaatagacattttcttttttttaattatactttaagttctagggtacatgtgcacaacatgcaggtttgttacatatgtatacatgtgccatgttggtgtgctgcacgcgttaactcgtcatttacattaggtatatctcctaacgctatccctcccccctccccccaccccatgacaggccctggtgtgtgatgttccccttcctgtgcccaagtgttctcattgttcaattcccacctatgagtgagaacatgtggtgtttggttttttgtccttgtgatagtttgctgagaatgatggtttccagcttcatccatgtccctacaaaggacaagaactcatcattttttatggctgcatggtattccatggtgtatatgtgccacattttcttaatccagtctatcattgttggacatttgggttggttccaggtctttgctattttgaatagtgccacaataaacatacatgtgcatgtgtctttatagcagcatgatttataatcctttgggtatatatccagtaatgggatggctgggtgaaatggtatttctagttctagatccttgagaaattgccacactgtcttccacaatggttggactagtttacagtcccaccaacagtgtaaaagtgttcccatttctccacatcctctccagcatctgttgtttcctgattttttaatgatcaccattctaactggtgtgagatggtatctcactgtggttttgatttgcatttctctgatggccagtgatgatgagcattttttcatgtgtcttttggctgcataaatgtcttcttttgagaagtgtctcaaaagacattttcaacagcagacttgatctaggagaagaaaagatgagggtattcgaacacaggacacttgaaattatcccttagaaagagaaagataaagaagaatgaaaaagaacaaataaggcctacaggaattgtgggacaccatcaagaaaactaacatttgtgttacaggaattcctgaaggagagagaaaagggcctagaaagcatatttaaggaagtaatggctgaaaatttcccaatttggggaaagataataacatttaggtacaggaagctcagaggtcaccaatcaaatttaacctaaaaataattttaccaagacacatcataaacaaattactgaaaaatcaaagaaaaagaatatcaaaaacagcaagagactttaagaacacgtcaaaagaatcatttactatgatcaagagggatttatccctggaattcaaagatggctcaacatatgcaaaccagcaaatgtgatataccatattaacaaaatgaaggataaaaatcatatgatcacctcaatagatgcataaaaactgacaaaagtcaacaccttctcatgataaaaacttttaacagattaggtatagagggaatttactcaacataaacaataaaagccatatgtgacaaacctatggctaacatcattctcagtggtgaaaagttgaaaggttttcctctaagattagggacaaggcagagatacccactgtattagtccattttcatgctgctgataaagacatacctgagactgggcaatttacaaaagaaagaggtttactggatttacagttccaggtggctggggaggcctcacaatcatggcagaaggtgaaagacacatctcacatggcagcagacaagagacaagagcttgtgcagggaaactcccctttttaaaccatcagatctcgtgagtcttattcaccatcatgagaacagcgcaggaaagacctgcccctatgattcagttacctcccactgggtccctcccgcaacatgtgggaattcaaaatgaaatgtgggtggggacacagtcaaaacatatcacccactctcaccacttcttttcaacatagtacagaaagtcctagccagaggaattaaacaagagaaacaataaaaggcaacatcatagaaaagaaagaagtaaaattgtctctattggatgatgacatgatcttatatataaaagatccaaagatccccccataaaactattggaaacaaattcagtaaacaaattcagtaaagttgtaggatacaaaatgaagagcatttttacataccaataatgaactactcaaaaaggaaagaaacaataaatcatacatttattctttatactttatttccatttacaatagcaacaaaaaattaaatacttaggtgtaaatttaaccaaagtggtaaaagacttgtatgttgaaaactataatcactgatgacagaacttgaaaaaaaaaaccacaaataaatggatagatatcccatactcacggattagaaaaattattattgtgaatatgttcatactatccaaagttgtctataagtttaatataatttccattaaaattccaatgccatttttcacagaaatggaaaaaacaattctaaatccatttgaaaccacaaaagactctgaatagccaaaacagtgttaagcaaaaagaacaaagctgaaggcattacactctcagatttcaaacatattataatgtgattgtaatgaagcctgcatggtagtggcataaaagcaggcacatctaccaatgaaacaggacttaaaaaaaaaataagataaaaacccaggcaattatagtcaaccaatttttgacaaaaagtttccaaggacacacaatggagaaaggatggtctcttcaataaatagtgttggaaaaaccaaatacatacattcatcagagtaaaattagagccttatagcctacactatacacaaaaatcaacttaagatagattaaaaacttaaatataggacctgaagctatgaaactactggaagaaaacatgagggaaatgcttcatgacattggtctgggcaatgatattttgataagacttcaaaagcacaggcaacaacgcagaaattgacaaatgagatggcatcaaactaaaaagcttttgcacagtaaaggaaacaattaacaaaatgaacagacaactcacagaacggaagaaaatagttgaataccataagaaaacagttgaatatcatgtgtctgacaaaaggttaatatccaaaatatataaggaaatcaaacaactgtgtagtaagaaaataacctgattgaaaaatgggcaaaggagcagaatagaaaattttcaaaagaaaacattcaaatggccaataggtagatgaaaaaatgctcagtatcgctaatcataagggaattgcaaattaaaaccacaaggaaatatcacctcaaatctattcaaatggtgtttatcaaaaagataaaagatggctgggcacagtggttcatgcctgttatcctagcactttgggaggcagaggtgggagaatcacttgagctcaggagttgagaccagcctcagtaacaaagtgagactctgtctctataaaaaatttaaaaattagcagggtgtggtggtacatgcctatagtctcagctactcagaaggctgaggccagaagatctctagattctgggaggtcaaggctgcagtgagctatgatcatgccactgcatgccagcctgggtgacagagcaagaccatgtctcagcgggggaaaaaaagaaagataacaagtgttggagtagatgcagagaaaagggaattcttacatgctgttggtgggaatttaagtacagccattgtgaaaagcagtgtagacagtcctcaaaagctaaaaatagaactaccgtatgacccagtaaccccacttctgggtatatacccagaggaaatgagatcagtatgttgaagggatgtctgcactcccacgattactgcagcattatttacgacagtcaagatatggaacagatgaatggataaagaaaaatgtgatatatatatatatatatatatacacacacacacaatggaatactatttagccttaaaaagaggaaaaactctgtcacttgcaacaccatggattaatttggcaaatattatggtaagtgaaataagcaaggcacaaaaggacaagtactgcatgatctcacttgtatgtggaatctgataaagttgaatttatagaagtagagaggagaataatggttaccagaggctggggagagaggctgtagagagggaggaaaagttgttgtccaaagggtacaaagtttcagatagacagaaggaatagcttttgagatctattgtgcagtagagtgattatagtcaatagctatgtattatatatttcaaaataacagagattatttcgaatgtctcaccataagaaatgatacgtaagtatggtgatagaaatgttaattagtttgatttaatcatgctacattgtatacgtttaccaaaaacatcacactgtatcatataaatgtatagaattatagtttgtctatcaaaatattgataatatgttttaaaaagaaataaacaaaaaaagaaataaaaagaatatgtagttggggtagggagattcttgtctcccgccttcactggggaaccctcaatctctaaatgattctcttgtgtcccatcttcatgtatataatacagctgttgcttctacatatctggtgctgggcctaacctcagcaggtcagagcatcagaaaggaaagatgtacataaagtggaggagagcaaggttgagctggaacctgcatcagcctcacacttctgaatctccagcttcaaagatgggtagccttgtagatgcaggtgcactgtgtcaagatgctaaacatacatctgacccaggagttaattgaaggaggaaatatgatgagagttagaagagctgtgagctggattgttgagttgtgtaaaatcaactcaacatgcttgagctgctacagcctctgaccttctgagagtaaatatgtctgctgcttcacttccgctttccaattctcatgcaaatgtcactgtggccaaccccatccctgaccatacagagaagaaaatactggaaaacacagttctaacttagctaggttgacttagtacaaaaatactacaaggcctgacttctaactccagtgattgcctcgttccccacccactttctgtcttctcatacagattcaaaggagacaggaaatgggtggtggataatgatagcagagctaacctctcaatagttctggatggcatctagcccagttattaaggatcttttttaaatgtgggcttcttgattcttcctgttctcagctttggacccaagtcaccaattccaaggcaacaggaaatgtcccacttaacatcccattacataagactgcatgtaaatgaatcttctgaaagagaagggatcactactagattatccatgtacagctttagctatttaagcatttccttctattattgcatgaacatgttcacaagtgtaataacaaattttaaagtgtacatcacaattttactaattcagatctataccacagattggaaaatataggccagtgctttttgaactataagaggaatgtataaattgataccaagtagatcattgttatcttagctatataatacttccccttccaaagaaacatatttctatgggaccaaaatattatttttttagcttgattgtactgtattattacagaactcagagtcctttcatgaaatattattactaggaaaaacatgaaaatgtaatagatactttattgatttatacatacaataccaattctaaggcttagattaggaagacatctactcaggatataaatgtggatgtataataaacttatttaaaagtttgtgaggtcaaattaactgcattggtaaaatgttctatattgactcctaagtgatttcctgagtatgttttgcttatgatttatgttccattcacccatatccattcactaccaaaaaggatttgaggtgactgattttctagatttaacctaattctatgcataattcaagataaataaactgtgaactatgtatgatttattttactcttcaactaaagctgtgtaaatattttctctgagcactgaatgtttctaaatcatggagaatatatttaaattcagcaactgatttgttgacagcaagtataatgaaaacctacaactacacacacacacaaacacatacacacaaatgtagaaaaagataggggaggatacactcccagctgtgaaaagcagttctctgaagaggagagtgaaaccacagaaggcaggaaggaggggcatacttgggtatcaggagagataaaagagggcttccacttgtaatttttacaatgaatataaactatacgaatatgcatttaaggaaacaaacactattttaattaaaagatcacataagttttaatttaaaagggcatagttgctaaataaaaataaattaatcctactttttattttattttaatttttttgagacagagtctcactctgtggcccaggctggagtgcagtggcatgatcttggctcactgcaacctctgtctcttgacttcaagcaatttgtgtgcctcagcctcctgagtagctgggattacaggtgtgcaccaccactcctagctaatttttgtatttttagtagagacagggtttcaccacgttgcccagactggtctcgaactcctggcctcaagtgatccacctgcctcagcctcccaaagtgctgggattgcaggtgtgagccaccacgcctggccccaaaataaattattctaaacataacactgtatgcatattaataatgattctaaatttttctattttttggcacaaaaatatctttatcatatattattaagtttaacaaaacaagcacattagaaagcatgtttagagtgtgtattagtcagggttctctaaagggacagaactaataggatagatgtacatatgaaagggtgtttattaggagaattgactcatatgatcacaagataaagtcctgcaacaggtaatctgcaagctgaggagcaaggaagccagtgcgagccccaaaacctcaaaagtaggaaaaccaacaatgcagccttcagtctgtggccaaatgcccaagagcccctggtaaatcactggtgtatgtccaagtgctgattggacactgctgatgtttgaaggcaggaagcatccagcatgggagaaagatggaggccagaagactcagcaactctgctctttccatgactgatttcatgttggcagctgattagatggtgcccacccagatttccaggttgagggtgggtctgcctctcccaatccactgactcaaatgttaatctcctttggcaacaccctcacagacatatccaggaacaatactttgcatccttttctttttttacacggagtctcgctgtgtcacccaggctggagtgcagtggcacgatctcggctcactgcaaactccacctcccgggttcatgccattctcctgcctcagcctcccaagtagctgggactacaggcacccgccaccaggcccggctaatttttttgtatttttagtagagatggggtttcaccatgttagccaggatgattttgatctcctgaccttgtgatctgccggtctcggcctcctaaagtgctgggattacaggcatgagccactgcgcccggcctactttgcatccttaaattcaatcaagttgacactcaatattaaccatcacagagtgattgcaattttataaaaatgttatctatctcaatctttcttcctctatctgtctatcaagagtgtatgtgtctgtttttgcatgtgtgtagaggaattgccacgaggataatctatacactaaaacattagagtgatcatctctaggtggagattacaggtgatctttctccacctcccatgctgttgcttcttctccttctcctcctccacctcttcattttccttttcctccattttctccttcttcttcatgctcacttgtctatattttcctaccttaaatatgtgttacttttatagcttaaaaattataaacataaaaagtaaatttcagataacagtaaccataatcataatagggttttgagaacccactacacaccaggcactatgtaaattcagtcagttcttaccatcccctgattgaggtaggtattattattattactattttatacatgaaaaaaaacccatatcttaaaaagtagggtggtatacctataatcccaacactttggaaggccaagactggaggattgcttgaggtgaggagttaaagacaagcctgggcaacatggcgaaaccctgtgtctacaaaacatgcaaaaattagccaggcatggtggtgtgcacctgtcatctcagctcctcaggaggctgaggtaggaggagcatttgagccccagagacagaggttgagtgagctgagattatgccacaacactcctagcctggaacacagagggagactctgtcaaagaaagaaacagagaaagagagaaagaaagaaagaaagatagaaagaaagaaagaaagaaagaaagaaagaaagaaagaaagaaagaaagaaagagagagagacagaaagaaagaaagaaggaaaagaaagaaagaaggaaaagaaagaaagaaagacagaaagaaagaaagaaaaagaaagaaggaaagagaaagaaagaaagaaagaaagaaagaaagaaagaaagaaagaaagaaagaaagaaagaaagtgagtgacttgttcaagttcatacagctagaaagataaattttagatataaggaaggggtccagtttcagttttctgcatatggtttgccagttttcccagccccatttattaaatagggaatcctttccccattgcttgtttttgtcaggtttgtcaaagattagatggttgtagatgtgtggcgttatttctgaggcctctgttctgtcccattggactatatatctgttttggtaccatacaaaaactaactcaaggtggataaaagatttaaatgtaaggcctaaaaccataaaaactctagaagaaaacctaggcaatactattcaggacataggcatgggcaaagacttcccgactaaaacaccgaaagaaatggcaacaaaagccaaaattgacaaatgggatctaattaaactaaagagcttctgcacagcaaaagaaactatcatcagagtgaacaggcaacctacagaatgggagaaaattgttgcaatctatccatctgacagaggactaatatccagaatctacaatgaactcaaacaaatttaccagaaaaaaaaaaaaaaaccaccaaaaagtgggtaaaggataagaacagacacttctaaagagaagacatttatgcggccaacaaacatatggaaagaggctcatcatcactggtcattagagaaatgcaaatcaaaaccacaatgagataccatctcacaccagttagaatggcaatcattaaaaagtcaggaaacaacagatactggagaggatgtggacaaataggaacgctcttacactgttggtggcagtgtaaattagttcaaccattgtggaagacagtgtggctattcctcaaggatctagaaccagaaataccatttgacccagccatccaattactgggtatatacccaaaggattataaatcattctactataaagacacatgcacaaatatgtttattgcagcactgttcacaatagcaaagacttggaaccaacccaaatgtccatcaatgatagactggataaagaaaatgtggcacatctacaccatggaatattatgcagccctaaaaaaggatgagttcatgtcctttgcaaggacatggatgaagctggaaactatcattctcagcaaactgacacaagaacagaaaaccaaacactgcatgttcttactcataagtgggagtggaacaatgagaacacatggacacagggaggggaacatcacacactggggcctgtcagcaggtggggggctaggggagggatagcatttggagaaatacctattgtagatgatgggttgatgggtgtagcaaaccaccatggcaattatatacctttgtaacaaacctgcgtgttctgcacacgtatcccagaacttaaaatataataaataaataaacataaaaaagaaagataaatttaaatctattggctttcaaagctcaggctcttttcctctacatcactaagtagagccacgaacacttttacctttactccttgaaatttaggaaagtcaaaggaaaacttggaaatcaaaggtttcattatattcaacatcatttaaataaggatatatgaaagagttcccatgtggctcttttctactggtctttatgtttcatttgtccaattggagaattacgaatcagaagtttacccatcatatacactcatatgcttttgagatcacatactgtatacatagacataatatataaatgcacatgtatattcatataaattatacatgtgtacacacatatccaaatataaagattagtaaatgaaaaattaacatcttcacattaagtaactgtttttgtacaaataatagaataatttttattttttaaagttacaaaaggcaaggaaggtaaaactggaaggtgagtgtggatacatgcatgttagcgtgtagtatgtgtacaatccatttgttcttaaaagtagtgagttgtgctaatttttccttctttatatattaaggtttttatgaagaattgtgggacagatttatatatatatatttatatatacacacatacatgtatataatcatacatacatgtatataatctaaggcagctgttccaattgctattaatattggattattaataataatccaaatagatccacaaaagccacagcaccaggagaacgagttctggattttcttgccctggaatactttccatgggaaaaagcccattaggtcaaacagatgaggcaacgtaggttcaagcagaatcatcatggcagtaccaaagacgttttcaagcacacaggttcagtataatctcctctatggacaattctgcccatttgccttgtgctgtcttcctttgtctgctttccaactcccccctggcccccaaacttcagctcagatttctctctatgtgttgggctacacctaataatcatttacttattttacatctagtattttcagtatattattagcaggagaagccactggtccccaagcagccgtcatcacctcctcctacaccttgaggtgctggacagagcagcccatgcccagctcttcagtttctgctgactctgcctctgttggttaaactcctgccatgatccagaatcaccttattctagtgaatacccgaatgttaacagtctacactcttgccttacctgtttcttccaatgcctcccctaaaatcctgatttaatttactctatgtctactgcctaaaccagatacatttttccttcttcaatgttaactacatttaaggtatcttttcttatcaaaaccatccaacactctaactactgcttatgtctttctgaaatgtcttctctctccctctgggtctaaaatgaaatgcatcttgtatcttttaaattttcttctctataccacccacgaaatctgtttccaccatataccacaaacaggtaatttatgaatgataaaaataccaaaaacttattcaatccttatcatataataggtgttttaaagccaattcatagatatttatttaaaccatataacaatccttgggggtaagtacattactaaccaaagttgataaattaaaggactaaggcacagaacaattatgcaacttgcccaagcttttacatccagcaagtagtagaggcaggatttaagccaagtcaatgagggtcacaggccatgtgctcagtaagtgtaccccctccctgttgcaattcctgttgctgaagtccatgcagtgttgtccctcgtccacgtgcttactgtctcacccacaatggaatcatgatgactaagttatatgactaaagaaaagatctctgctgcttctctctcaccaattccattctgggtccttagtgcaagaacatgagggcaaagaatgttggttgactgttattaaaaagaagaacagtcaaacaaacaaactgaatcctttgctattatcctgccttgaatggcatatgttccctggaacaaccatctatttgctaataaaaaatatcgcattacagatctgataaaaaagcatgtattggaatatctgctatgtgggaggcattattctatgcatgttcaccacattaatgtatttgactaaagaagatgagcagagagaggtatggtcatgaagaaggtggggatctggagccaatagcagacataatatggaaaaggaattaaatttaagtgggaataaatgcttcagttactaacataagagaaaatgacactgtgcatctattgccatttagacactgagcaatctgaaaaattggtccactcagtcataaaaagccacgacagactgactctgaaatcatatccaatatatattttcataatagatgtgagtgagtacatggaaataaaatgtatggtcccaaggtttgaaattattcatttgacctggtgttacagtgttacaacagaatgtagttaataagatcaatacacagaggatgggcttcccatgcttgattttaaagaatatttcatgtaaactgctctgtatttccatggaaacacaaagggaactccatagtgcagtgagcaggaggtaatagagaaaagagagagaattagcaggcttggttactgttaataattacctgggtagcaattattgcttttggaaagtgcacaatctttgtagctgtcactcattggtgacctcagatttcacttagtctggaagccaaaggatttagttcatttcatttgcattcagaaagcccccccacctataaccaccaatcccaagatatgtcaaagtaccttttctcagatcttgcttagaaagagcactcatatgtgggagaaaaggcacaatctgtttagccttaaggtaccaactttttcatttacccagctcttggctcctagtgattttgttcagaattagagaagagttagccaaatgcccagagaagcagctgttcctctaaaacaaactggaaaggaaaacaatcactcctcctgccccccactagaagaaggcaaatggttccaaaactgatggttttaaggattgtctaccactctacttaggaatatgttttccgaagaattaaggccctgtggacatcctagagtgaggaagctctgtgctataaaggaacatggtgctcaggcataagaaagagtgaaaagaagatagagctggttaatctagcctttaattagctgcatttccacggaaacgctttcccattttcccagttgtctctgtaaatcaatttagagctgctttgcttaggctccaggcagacagagtggaatcacagtccttcaaagaggtgtgagtttttctcatttatcatcctggggtgcttgcttcaaagcctagttggaggactacttaaaggaaaacaaatctaaacaaaacggaactgtgccgtctggatttggttgaaaatcttgggaatgtgcggcagaaaattccaagcacagacctggaaagtgatttgcaagagacctcacaaagggcttagaaaaaataaacaatcagtgaactcacatccacaaacatacacacacacacataggcagtgggactggaatagaaatgtgaactttattggaaaccacatttggcacaggaattggccttcctggctttggccttcagcaagtaggttactaccgaatttttgacaaggcttccaagcttgacagcctttctacattaattggttcgcactcagccctgtaaatatttaagctacctgtggcattgggaacgtgataagattatgtgattagttatgtgattaggattagtaggttctctgataagaaagacttaaagtttacaaatttagaaagagtatgaaaatacgtgtgtgtgtgttcacttgtgtgtgcgtgtccagctttaaagaagatcaggtcacacgtcactgattttagttactacaaagtcggggtgaggtggggtggggagaacctttcaaggccatagaagaggactagtcccaaagcatgaagcatctgagcctaaagagattttggactaggattttcaagtgtttttcagtttgtggacatctgttgacttactgagaaacacctgaggggcaaagaaaaccattgtaattcagccatctggtcatcttcttgttcaagcatctgtcttctgtaccctcttccctagaccaccaggccagtggtgttcaaagctttttgatctcagcctattgtaagaaatatattttacaatgcaacccaggatattcacaatacttccatagatattatggaaataaatgttcacgaacaatacttaaccaaagttcactttggtattttctagtctattctattctattttctttaatgcttgtcatgactcactaaattaattttatgtctcactaatgaattgtgtcctgctgtttgaaaacactacgctagaatgtattaaccttagggacaagtattctaatcactctgtatctcagctcctaacacttggtcactcagtaagtatttactgaataaatgagtggtaaatcaataaatgaataagttgaagctaatattctatattcagtatacaaaacaagaatattgactggcctagaagtaatatttaagctacaaattaatcaggaaaaatataaaataaaaggtaaatatcacccttcaggtggtggttttaggtatttgggtgaacattattacctgctccctggtagtaataataataatagttatgaccataagaatgatgattgcccacacttattaatcagttaccacgtaccagctatctctgtgctaggagaggagctatgaagatgaatgccactaattccagttcttaaaaaggttctgctatagaactcttccaagtcatctcccaatgacctggaacgaccaagtgacctggaatttgaattccaggtgagatcataacctttggctggtatggaaaagtggaaatgacatctataagagaggtggagatgagagtgacaacatctgcttgccaacagtttttatagacatctgctcagtgaacagaggagtagggagagagaagagaggtagaagatgcatcactgctattaaagaattattcaggacaatttctcttgcccctaataaaagacactgtgccatcctgtggaaacatcaccatgatagtaaggaatattatgtattgattaaaagcttgttctctagtcagaagaacttgtttcaaatcctaatctgctacttcctaactaggtggcattggtcaaattgcatattttttctttacctcagcaataggatggggattctttaagatctattctatcaggctgttttaagacagaagttaaaaatgcaactgtctacaggggcctgattataattaaatgaattaaggtggtaaaaaaaatagggaatggtgctgattgtagaaaactggatagcacaggccccatttaaagtcattcaaatttatcttttgaaaacacagttccagcctacaggccagatttgtctgcatgccatcagtctgcaattaaataagacaatgatcataaaatgcttcccacagtgcctagcacatagtaagcactctataaattggagctattattagctattattttatcacatttaaaaaatccctaggaccatttgcagattctctttaagagaggaaataaatggcctcagaattactccattgcgtgccccagttaatggcatcattaaaaataaacaggccttgaagaacacacaatagggacaggacagcctcttcaataaatgatgttggtaaaactggatgtccacatgccgaataatgaaatcagacttatcttattcttaacatattaaaaaaaatctcaaaatgaatgaaagacttaaatgtaagatctgaaactatgaaactattagaagaaaacataggggaaaagctccgtgacattggtctgggcaatgactttttggataagaccttaaaagcacaggcaacaaaagcaaaaaacagacaaatgggattatgtcaacctaaaaagcttctgcacagcaaacaaacaatcaacagaggacacaatttgcagaatgagagaaaatatttgcaaactatccatctgaccaagggttgatgtccaaaatatataaggaattcaaacaactatatagtagaaaaaaataagttaaaaacatgcaaaatatctgaatacaaatttctcaaaagaagacatacatatggccaacatgtatattaaaaaagtgctcaaagatcactaatcatcagagaaatgcaaatcagaaccgcaatgagctattatctcatcccagttacaatgactattatcaaaaggacaaagatagcatggagaaaagagaacccttgtacactcttggtgggaatgtaaattagtacagctattatggaaaacagtagggaagtttccccaatattaaaaatagaactaccatatgatccagcaatcccactactatgtatacatttaaaggaaatgcaatcactacgtcaaaaagatatctacattcccatgtttactgcagcattattcacaatagccaaaatatgaaatcaatcttagtgtcaatcaacagatgagtggataaagaaaatgtggcctatatacacaatgaaatactatttaaccacaaaaaggaatgaaatcctgctgtttgtgacaatattgatgaacgtagaggacattacgttaagtaaaataagccaaatccagaaagataaatactgcatgatcttcctcatgtgaaatctaaaaatgttgatctcatagaagtagagagcagaatggtggttattagaggctgaggtttttgaagggaaggagggatggggaggtgtttgtcaagggatatatgaattcaattagacaggagggataaattttaagatctatttcatagcaaagtgactacagataatgacaatatatggtattcttgaaaatatgctctcaccacagaaatgataactatgtgaggtaatatatttgttgattggtttgatataaccactactcaatgtatatatacttcaaaacataatgctttacatgataaaaacatacaatgtcaatttttttttaaatgggctttaggccaattcagtgatacaataagtaaagaagcctgcagttggttgtcgttaaataagagaatgtgaatgatctcatgtttaggaagccagaaccatccatggtgtgcagggaagctgtgcaggggagacccctggaatacattttggactctgataccattgtaatgatgagtagcaaagcagttgcttaaggaagcagaaaagaagggattcctgccagctggtattcaattctacctgcccatcccttccaaggtaacatcatagaaggctttggggtttgatagactttggggtacagccctcatttcccccacctgcaacacacaaggggattttaccagcctaagctttgcttgtctcctctgttacattaaggatggtaatgcattagcactgatggttcagccagcactctgctgcataagaggggttcaatacttttaaccttccttcctcctcatttcctgtgaatagttttacattgttcaggctatttattttttgctcaaacacctcctaaatttccatctgtctaaaaatgggggcaggaaagtgcccaaagtctcatcagtcctgcctgctctcaccctgccactcccttccctaattgacatccatgggttccaaaggacccaaatggctccccaccctgccctcacttcttccgccttccatagaaacgtgccattctgctcgggcttctgcccccgccttgcagagcccatcaggcttactagaaagctccccaaagggcaataaaaatttttgtcaatctcaggcccacctgcggcatctcttgagtacacatccccctgtctgtcctcctcctttgattccgggctttgtaaatcttttaccacatgttgtcaaaagcctggcagatcccccaaatccttccctgataacactcattctctttaaacaacctggcagtacttctaagtgagaaaaagccctaaaataaaatacaccgtgtttagtctctaaggtcatttcctggctttgtccagccgtttctgtttcctctaactaatcaccaagcgacagtcctggatttattgtggaggctacttgaaagtttgggtgaacctctcaagccagactacacacaccctccatcacccttcctcccacttcccagcaatttctcactcactgtgatttagtgtaggggcttgaggtgcaactgtgaccacagctacatcttcgtcaccaaagctatttggaaggcaaaggggccaaaccagcatggtctacacagctgagcactgtggttatgatacagcccgtgagtccatgcctggctgggggacagcagccttccacgtcccaggcagtaagtggcaggagagctgtgtgtcacccttggcatgctcatcattaatttccaactttcagtaggtgctctctaataatgacacctaatgttttaaaaggattttcatgggcaaggtgaattgctttacttcatttactatcacaacaaccatgtgaggtaagaactcttcataaagaatttttagaaacaccacagttccaacctcagtccatctgactgcagcatccatgctcttatgggtctctgttgggctgtgatattctcaccccacagtactgatccaaaggttggatactgcctgatctcaatggaaaacaaccatagtcaaacacacctatacttgtgaaatgtcaggcagtttttgagatactacatagattattgcatttaaccctcacaacaacccaagaaatggttatgtttatgagttccattttacaaaggtggaaatgggattccatgttagaagcagcatttgaactcaggcaatatgagctttaaccctgatactagctagagttcctgggatatgggtaagtgtgtgtgtgtctgtgtgtgtgtatgtgtgtgtatgcatgtatgtgtgtgtggtggaggaaccaggtgaaacaagcagttatattatggtgtgacaagccccatgttagtgttgcacaaagggtgctgtggcagcatagaaaatgggcctgtactaaacttgagggttttttgaaatggcatcacaaaataggtgacattggaggtgaactttgatggagtagaaaagtttaccgcattagaaagtttaataggagctctctggagagcacattttagacctagagagcagcatatgcaaaggcatacagcaccacaggcaggactgagcccctgcactggttccccaggactggagggaggaggcaggacattgagtgacttggcaatggagcagaggccagatgtgaagatacttttaaattgttctatcacatttgaaattatttctgaaagttatggggaaccttgaagggtttcaggagagcagttctgtgatcacctgggtgttttagataaatcgctacctaaagggtatactgaaggggaagtcatatctgaggtctggagagagctgctacggtaaccgagctcctcctgtacaaccatgcagaaaggcagtgtgaaagtgcaattgcaccacacagaaaggctccaagtgccatactatgaggaggaaggggactgactggctgcaccaatacggtgagccagtcatctggtcactcatcacatttcctgtatgcctatgatcttctgggactatactcacaactttctggacaaaccccaccctttctggctccatgtctttctccactactgcagcatcacttacagacttttcagtatgtgccaggtgctgttgtaagagttctgtaaatactacctcatttaatttgcttatataaggcagttatgaagtgggtataaccataatcacagttttacagataagaaaactattagtaactatttagtgaaatgagtcctcttaggaaactaccaggagagtggagagagatgaggaagttgcaaatgtagtatcccttaatatgtcattctatgtagctaagtgatgactccacccgctgctcacccccaccctactctcacctcacatggtcactggcacttcctattggaggaaagaaacccttttggtgaggaaaagatttgctagactgcttctttattccttggcccgtccaaagacatcatgtatgctgtgataatgccactctgctttcaatatttagaatatagagagagatatggatatagatatatatgtatacacacacatatatattcacatacacacatatatatgtatacacacacatatatattcacatacacatacatatatgtgtaggtgaagagaattgctttactttgcacatacacacacaccctgtgtgtgtgtgttatttctctacttataaaatgtgtgtgtgcgcatatatatatatacacatatataaaatatatttctcttttaaagtgtgtgtgtgcccatatatatgtacacacactttatatatatatatatatatatataatttttttctgtacttataaagtgtgtgtgtgcgcatatgtgcacacacacactttaaaagtagagaaaaatctcatggtgcattgaaatgctaagaattaaatttttataaattaaagagtaagccaccaatgaatggattataaataagtttaaatttagtggaccataattgtgagagaaggatgtacttttttaaaaaaatcaaaagatcactaggaataacaccaatgtctatcacagagttatgtgagggttcactgagatgagctgtaaaaggtgtcactacaaaacttgttatagaacacagcctccatatacatcattccattcccaggtccccagggatagaactccaggctgctggtcagccccaatcctgactctaggattttggcacttgtatccagacaacctaggactcagctacaagtcacctctgttgctgtaggggcgttggtgggctggtaaatgtttaacaacagcacgagagaaagaaagaaaaagcccagatttgtagtgtgcaccaattctaattgtgtaaatactcccataatcaccgatatcaaaatatcaatatgatatcagagaacctagagttgagagggacacaattcagatcttatgagtcagtgtctgcgtttcaagctcgtgactgccccaagggactctgactatgcgtctagtctgatgggctcctatgtatttcctaaggcctgatctataccttgaacagccttctatcttatcaggttcttcagtttttgttaccctggacctttttaaccgattaaagctttgggtgggaattgaggccaggaaatgctcttgtctctttcaaatgggagatacttcaatctaaattccttaattctctctgttacaatgattgcacgtcttttcactgtttaattaacagaggagagctctcttgtatatttgacccacagcaattaagccaccagcaaagtttgcagggaaaagaaggatgatgatttaattagaggttaaataatgaattattaattattgaattgaattagtattaattagtttgtaaagtgcaataattacatcttttgtgttttagtatgggactgtgttttataattatctgctaaatcaattatgtagccattagcattttgcccaagggtcgggttaccattgttttttgttctctgcagactgtagatgacagagaagtacggtaactatgttccttcacataaattgtatcctgtttacagtaaaatgttagacaacttaggtcattgagtgctcagtttttcagttaatgtggacaaggagatgaacaattctgcattatttatcgtagaaagcattttgcccttagagtttcttgccatgaatgaggtggtggcgggagctggttctagtaaggaacaggaaggacccaacccagggaggagtggggtaaaggtgaagcagggtagggacaggagcagggatggaaaaacacagtgtattgcaagctgacttaactattcctcattcccagcggctgaccgaaaactagaaaatggcaagacgtaactccgatttccctttttacagctggtatgctttgccttttggggtcaaaaataccttggtgaatcagatattcaacactgcacaaaaggttgaatataattttagagttcatgcgtcccctgaagttcattcacgaactcacagatttagattttcagggtttagaaatctgcatcttaaataagcagttaaaggaggttttatgtgtctgagaaacatgactgtgtggctttctaggttaaaaatccctcatacctggtgttttcaaaaagaccttgagcagtgtagtaatagtgaaagaataacagcattagattcagacagacctgggtccaaattcaagcttctccacttaattgctgagcacgtcatttaattgttctaagcctcaattcctccaccacagataagtggagacttgcaatgaaatacttgatatggtacctaatagggatgtaatacctaatatgcaggactgctaggagaaataaatgaaaaaatgaattggaaaatactggtcttaagaaatgtttgtgactcccttttactttttagtagacaggtggagggtagagagttgatagaaataatttgtgacaatggacaggattcttattacagagtgtggagaactgaataattgctaaagaaatgcattataatttactaaatcaaggttacgatgatatgcccagacagcagtatctgataatacattagcatggtaaaagacactcccaccagtgccctgacggtttaagattccacagcaactcacagaagttaccctatgtggtctaaaaaggggaggaacccttacttgtgagaattccctgcccctttcctagaaaactcatgaataatccaccccttttttagcatatgatcaggaaataacctttaaaaatagcctaccagcagcccttagggctgctctgcctagggaatagccacccttttactcctttaataaacttgttttcactttactctgttggctcactcttgaattctttcctgcaagaagccaagaactcatgtggccttctaggctgaacctcaaaattaccacattagcactgtagatatttttccaaactggactgtaacagtgaggacaaagttgaccaaagagagaaagttaaagatatggaggaaattttgccaaagatctaaaaaggattgaaaatgcctcaaaagcactgtcagctctcactggctatccttcctgcttgattatctacacgaccccttccttacaaaatagtttcaacctggataaaatattctttttattatagaaatattcttcaggttttatagcagaagttgatgtaaaagcataagatttgctctatgcaaattgtctttgtagaaataaaagatgcctaaactgatttgaaacacctctctgtggtactgcattacttttgccttcatttccttctttcagatgttttacaaatggattcagctgctggggaaaatgtacttattttaaacactctggccttttaagttttttttttttttttttttttttttgagacggagtctctctctgtcgcccaggctggaatgcagtggcgcgatctctgctcactgcaagctctgcaccccccaccccgggttcactccattctgctgcctcagcttcccgaggagctgggattacagtggcccgccactatgcccggctaattttttttgtatttttagtagagacggggtttcaccgtgttagccaggatggtctcgatctcctgaactcgtgatccgcccgccttgacctcccaaagtgctgggattacaggcgtgagccaccgcgcccggcctgccttttaagatttaagaaccagtagatactgtttaaaatggaactagcactgattccacaattgttggtgaatgttcaataggaaaaaaagattccattttaagggagcttatattacaaaattacattggtgaacgtgcatgtttgaaattcatactccatttcctctataggaatgtcacaaatggtaaattgtgacacttcccaggttttcccaagaaaaaatatagttaaaatgtgctgtataattaaatgaaaaatatatatatactagaaaaaagtaccatattattatacttacagaaattgagaaaaaaataagagcaatgaatgtggtagaattttgaagactagggctgagtcctagttctaatttttactgacattaggaaaaccatttaaggtctctgaacatccacaacagttaggtatgaaaactcttgattttacacccggaatgaagtaagttctaaataagtttggtaagttaagtggggtgattaaataagacaatacttgtaaagcactatagtgtccattatataggaaatgctcaataaatattagctatcattaccaggattaatcattttgaactgttggaaacttaattaagatgtataagtttgccaagaatatgccagttcctgaaaaaagtggagacttccaatgaaaaatgaagctgcagaagattttgaaacaggctgtgcatggtggctcacacctataatcccagcattttgggaggccaagaaaggaggattgcttgagcccaggagttcaacaccaatctgggcaacatagtgagacctcatctctacaaaaaataaaaaagttagctgggtgtggtggtgcacatgtgtagtcccagctattcgggaggctgaggctgaagtgggaggatcacttgagctcaggacgtccaggctgcagtgagccaggatagcgctgcactccaacctgggtgacagagtgagaacctgtctcaataaataaataaataaattgaaatggacatctctctgaacctttgaaaggtttaaaagttgatggtgctaggttttcttctcatccaatttcatgtcaaaaccactgccttgctgttccctagaaagaaagttatcaatagcagaacagttattctttgcctgaaatggctaggggtataatttggctcggataggagtcctaaggaagaataaaaggcaagagaaagagagaatgaatgtgatttataagataattggaaaggagagagaaaaagagaaaggatatggggagagaatgaaatgtctaagaattgagtgattctctctgagcagaagttttgaaaagaaaccgaagtagattcaaagagctctccatactacctcccaagcggcaataacattttagttttatttgttaattcagattgtattttcattatatattgacaaattttagttgtatatatttatgaggcacaaagtgatgctatgattttttaatataatgtagaataattaaatcaacctaattaacctatccgttacctcaaatatttgacacttgttgtaatgggaacatttgagatttattctcttagcaatattgaaatgtacagtactcaattattagctataattaccacattgtgcaatagaacttagaaaaaaaatcaaacttattcctcccgtctaattgaagctctgtaccctctgattattatcttcccattcccccccactacccagtcttcggtaactaccattctgttctctgcttctatgagttcaattgttttagattccacatgtaagtgagaacatgcagtatctgattttctgcgtctgtcttatttcacttagcaaaacatcctccagtttcatgcatgttgtcacaaatgacaaaatttcttcctttttaaaggctgaatagaattccattgtgtatatacagtcatctttcggtatccctgggggatcagttataggatgccggaggataccacaatgcaggatgcttgattcccttatatcaaatggtgtagtatttgcatataacctatgcacacacatatatatgtgtatatatatgtgtgtgtgtatatacatatgtatatatgtgtgtgtgtgtgtgcgtatatatatgtatgtatgtatatacatggagttttgctcgttacccaggctggagtgcaatggcgtgatctcagctcactgcaacctctgccacccaggttcaagagattctcctgcctcagcctcccaagtagctgggattacaggtgaccatcaccacatccagctaatttttttgtacttttagtagaaatggagtttccccatgttggccaggctggtcttgaactcctgaccccaggttacccacccacctcggcctcccaaagtgctgggattacaggcgtgagccgctgcacctggcctatattttaaatcatctatagattacttacacgcccaacacaatgtaaagactatgtaaatattgtttgcactttatggtttagggaataatgacaggagagaaaagtctgtacatgtacagactcaaccatccactttttttgcctgaatgttttcgatttgaagttggttgattccacagatgcagaactcacagatactgagggctgactgtatatgacatttgctctatttatctgttgatgcacaattaggttgattctataactcagctattgtgaatagtgctgcaatatatatgggtgtacagatatctccttcacattaatccatagggtaaatactcagaagtgagattactgaattgacagtaacattctggtggggtcctagggcaagggtaagtgagtcaaatgtaaaacatggtcccaaatagactatttacaagtcaggcgcttatgatttgggcaatgtctaacacagtggttctcaactatggggcatttttgcctcccaagaaatatttggtaatgtctggagacactttggattgtcttgagtttatgactcggaagaaggacaagacaagggatgggttgtgtaaatggcctctagtaggtgggggccagggatgctgcaaaacattccacaaggaagagcccagctcttcaactaagggccagccccaaatgtcaaaaatgctgaggtttgaaaatcctgaccaaaagcaatatcaaaaaattattttaggatgattacaatattatcacttcaaaagttttgatcaaaaaacatcagaattgggagggtttggagaaaatgagcttattctccattatctgagagtataaatgttggatgtttcaggttttcagctctttggggtcatcttaattccaaagtatggcagactgttttaaaattgaatctcccaaaaatattcccatataattagaggcattgactccagagttaagtttcttgcacttgaattccacctctgccatttcccagctgtgtaagcttgaacaagttaacctctaagcttcaatttctttgtctgttaagtgaagataataagacagccctcacaagagatgagagatgaatgagctaactaataataatagctattgcccttgtcattgtttcaactgtttcctctcaggtgactggggtctttggcccaataccccagtaaggaccttgattacctcctaggctggaattatatatccagtgtcagaggtggaaggcctaagcctggaagcctgactcaacgcagtgctctctgcaggtgaccctacgaataaaaactcaacacactgcagaaatgctgagtgtgaggcacttttatttgcagtgctttctcttctcccatcctctccctttctacgatattttttttcagcagagtcagtaaaagaaacaaacaaaaaaaaaaaaaaaggcttttcttgcaagataaaatcaggaattaaactaaaagtcacagtctcctcatttgcattttaaaagtactagtttcacaaataataagcaaaaacagattgttacagattgttagattacaggcctgatattacagtggcacagataatagaaggagtaaaaccacatggaggcacagaataatttctgctgctaaggaggcaggaaagataagtcgagaaaagtcttagaaagagaaaatcaaactgaatttattttttaagtttcgtaaaatttttttaaaagcaggcttaaaatgtgttttttaagtaagaaaatggatgcgtcttaaatagaaatggaaattcaacataatataaaatgtcacagaagtaatggactaagagagaacagatgttaaaacttaaattaaaaaggtgtgggtgaaggagaaaaagaaagcaagaggaaaatatagacagaagggggaaaggaggcggcatggtgtggtggaaagacgctgagccagacgggctggccctgagttttagccctggtgtgtctcttctgtgaccttgacaaaatctcaaacttctttgtgcctcaaatgacccaaagggactacctgtgttctgctatgtctagagccaccctgggcctgtcctggtgtactgcaggggagtggggcagatgaagacgacctggaagctggaattggggatgccaactgggatgcggcagctggcagcaaggctgagggaaaggttgggagggaaacccagtccagggcaggaggaaatttctggaaggtgcaagaacaatggtggacattagggagcagaagctgtgataacaatgttattcccatgggtgacccaactatattgggaagaatttaggagcaggtgagacaagcaggagggcaggaggttggcattgtggaaataggcagcaagtccccagttcctgggcttaggtttcgggacatgtttccactccccaggggtggctcactgtcagggcaacttggagcccactgctggaaacttggaggtactgggcacaggggaagaaaatggggattcagttgtaagaattggagaatgaggtaggaaccaagtcacagaaacaaggataaaaagtctctcccatatcaggaaagaggcagagctggaactgtagggaagagatagcaaggaccaaggataccagatatgaggatgctgagaaagttctctgtagctttaatattccttcatttattcatccattcactcagcttaggcagaggtcaaatgatgggttctaaatatgtgctaagttgtatggtcaagtctcatcttttccgtttcccagctctgtgtcattgggtgagtaactaaacactaacttttgattataaaataaggttgaaattatttcataaattgattgttgtgaagtatgtaaacatgtacatggcacagttccaagaacaaggtatgtgctcaacaaatggaagctatcatcattcattcattcaacatgtaaccaacacttaccatcttgaatctaagtcaagagcgatggaacgattttttgttgttgttagtgtttaaagattttggtgctattaaaaatcttggtgctatgttttgttgtaataaatagaacaaaaataggtatatgggagaagtttgagagacattttgctctaaggaatgtgaaaagcagccagagaaactcatgctaatgctaatatggttcagaatgattccagctttagggtgggaaggagggctggttaagatggaataatgaatcaaatggtggttatgctgttgctaggacttctgagcttacagcaagataccagagggtcttgctggctctatcccaatgtgcgtcacccatttcttttcaacccccaccaaatgaccgaggcaaaaatgccttcaagggcaggaatctgagttcccattggctctacttttccaagatccacttctagacttattctttgtggctacatagaaatacatgaattaagttctgaggttctaagtggttgcagaactagctgggattgcccacagtcattcatcagtgaagatgcatcatggctatttacaattatttttccttctggaaagctaacccagggaagggaaaggacagcacagccccagagcctacacaagctgctttccacatgtattttgtagttttaatcctcacaacaagcctaagagttgagccgtttgtctacctgtggcagacaagggttagaagcttaataattttctatgggtcacacaacctatatgaaggggagacaggacctgtgcacagatctgtttaattcctaacgtaatgcttttattctctcctaaaaagggcagctctgctaattacaggctctgaattttttttaggacatcgactttcttttaaagaagcaatgtctaaaaataaagcaggttaacctgtgtgcttgcatatgagaatgaggagagagaaagagagagagtgcgtgtgtgtacgcgtgcgcgcgtgcgcacgtgtgcgcgcagaagcatgcatgagaaaaagaaagagagatagggaggtatttcttctttcatatacaaagcagcagcccctcctctgtctttttcattccagtgtaatctatgcacatgcaaaataattacttcttcctgtaggaagtgtcagtcctccaagcaaagaagaaaaggctacagcatatgttaccgacacatgtttttgctagtcttgtctctgttccgcctgctgtggcaatcagcttttgcaaatactgtcacttaccaaatacaaaaagcatgtgcatgcccagccaatggcctgggataaacacagccaggctttctgacttggaacatccacccaggacaggggttttgtttccaaagaacaaaaccagccttgtatcatcaaaatcagtggtggggagggagagagggcagttacgatagaggaaagacatggacccaacccaacaaactgcttcagggtctgcctcatacatatgaaggaaaattgatagtatttgataggaggtctgctcaattcagccaaaggaaagatgggcagggctcaaaaacactgctggagaagttggtatctggccaaatggctaagtagccagtcgggggtctaagaagcacatgcacagaagggctttgagctctgcctcttggcaggatgcccacccatcaagttcttccagagtggggagttggcaatgcgcactcctaatcccagaagcacttgacaggtaggcttgctgccgagagcccccctttctgtcccctcaggtgccagactctgcactgtggccgcagcagctacaagcgctaccatgagacaaaggagaagagtctggcacctgtggtggggagcctgtcatcttgtggtgggacatttgcctggtacttcctggcctggcaaatgtgccactgaggggagcactgtccctggtgggcagactgtggcaggaattggctggggtcaagagggcacagctctggagatctccaacctgccatgagtccagcactttccagaaggcagcctctaagtatatttaaataataagcaggaagaaatggtggacatttgtggtgtctagggaaaggaaaagaacaacttcacttaaagatacagtcacaagagagaaatctgaactgagtgtacacccctgaggaactctggaatatctgagaaagcatcaaggatttcatttgcataaggacatctgagccttctggaagaaatgttatagaggacttttagagctgacagcttgattctgcaatcctagatctaagatttctgaagtaagaatgaaaaccaaagttatctaaccctaggggactgagtcatgggagaaagcacccaccaaggtaggggtgagaggacatggccttccttctgggtcctaggccttattgctaagggacatgttcatttatccttccaatattctccttttcagtagcagagaatgcaggcatacctccttttattgtgctttgctttattgcactttgcaggtagtgtgttttttacaaattgaaggtttgtggcaacaatatctatgtgccatttttccaacagcatgtgctcacttcatgtctctgtgtcatgttttgataatgcttgcaatatttcaaactttttcattattattttatctgttgtggtggtctgtgaccagtaatctttgatgtcactattttaattgctttgaggcaccacaagccatgcccatgtaagatggaaaacttaattgataaatgttatgtgtattttaatggctccaatgactggcttttccccatttctctccttctccttgggtctccctatttcctagacacgatatggaaattggaccaattaataaccctacaatggcctgtaggtgttcaggtgaaagaaagagtcacacacctttcactttaattcaaaagccacaaatgattaagcttagtgaggaaggcatgtcgaaagctgagacacgccaaaagctagggctcttgcaccagttagcaaaggtataaatgtaaaggaaatgttcttgaaggaaattaaaagtgctactccagtgagcaaaagaacgaaaagaaagtgaaacaaacttattacctatatggagatatacagagtgatgaatgttgttttcttgcctgctaacacaacacccattctgcagcccatgtgtcaagcagtaattttgactttcaagtctcattatttagaaagtacattttgtaaggtgatagctgccatagatagtgattctctctgatggatctggacaaagtatattgaaaagcttctggaaaggattcactattctggatgccattaagggcatttgtgattcataccaggagatcaaaacatcaacattaatgggagtttggaagaagctgattccagccctcatagatgaccttgagaggtttaagacttcagtgagaaagtcactgcagatgtggtgggaatagtaagagaacttgaattagaagtgaaacctgaagatggcaccgaatggccacaatctcatgacaaaacttgaacagataaggaattgcttcttatggaggaggaaagaaagtagtttattgagatgcaatatgcttctgatgaagttgctgtgttgaaatgatgaagaggatttagaataaacttagttgataaagcagtggcagggttttgagaggactgaccgattttgaaagaatttctactgtgggtaaaatgctatcaaacagtatcacatgctacagaaaaaaatctttcataaaaggaaaaatcaatcaatgcagcaaatttcattgttgtctcattttaagaaattgccagagccatcccaaccatcagcaaccactaccctggtcagcagccatcaacgtcaagacaagaccctctaccagcaaaagattataactcactgaaggcttagatgatcactagcacttttttttttagcagtaaagtattttttattgtgtatattttgaaacacaatgcaaactttttatacataatggtattccacacttaatagactatagtgtaaacgtaacttttacatgcacgacgaaaccaaaaaatgttggtgacttgctttattgtgatggtctggaacctgaacctgaaatatctctgaggtattcctgtatatgctaagccttaaagcctaaaggtctgcaatcacaaaagacagaacctaccatttctgctctgaaaagagcagtatttgtgagcacaggatccccgaaccaccatgaacgcatggggagggcagggaggatgtttagtttcacttaacattgggaggcagggttgtgctcatggctgtggagttaccgctcattccattccttttgctgggtcaaggaaaccaggatatctaggtggaagattctgggcttgggtcctcactgggtccttgggacaacgcatattttatctcatctaatcaattggggataaaaattatacaatgacccagatcataaaagaaaactgatgtggagctataaagctccaaagaaatgcaaattgttattttctgctacagtgttagaattctgattatcctatttttttgtttgtttctttgtatataggccctaatgctaccatgcacacagtatcactaagtcattaagcttccataatactcagtgaagcaaaaattacccccaaccactcatacttggttgtttttagagtgactcagcacagggtgagcacatgacttacacaggttacatcttcaagtgttaagatttatctggtatgtggctgtcaacaatactggggaccatttgagagcaggaaccatcttttctcttgctgcctgactagcttctagcacagtgtctggtataaagttagtgctcagtatatttttgttgtattaaataaaatgtatcaatttaggtgctttaaacatttctatacatggatcgtatagatatactatgcatttggcaaaaatttattgagaacttactatatgctagaccctgtgccaggcactgtgtatacgatgtaaaaaggatgcttgcagcctagtggggaagacagacctcaccaaatgatcgcattaataaacacagaattgcaaaagaagcacagatttctcagagagcgtgtacaaagcagctgatctactaggtggggagtctccctaaggaaatgatacttcagctaagacttgaaagaagagtgagaattaatatggttaagtagaacacaaaaaaggaacaccttattattattattattatcattatttttcaagacagagtctcgcactgtcgcccgggctggagtgcggtggcacaatcttggcttactgcaatctctgcctcccaggttcaagcgactctcctgcctcagcctcctgagtagctaggattacaggcgcccgctaccacgccaggctaattttttgtgtttttagtagaggcggggtttcactatgttggccaggctgctcttgaattcctgacctcgtgatctgcctgcctcggcctcccaaagagctggaattacaggggtgagccactgcactgggccacatgttattaatactatgtgccacacactgttctgctggccgtccatgcatgcttatatcattctcacaatgatcctgtttggaactactatgagtgtgcctaatcatacggtgagaaaatcaaggtgtgagcggtcaagtgtcttgcccaagagccagtgagtgatgggtttgaacctggtaggctggttctagagccacactccccacatatggagagaacaactagtgcaaaggacctgtgccttagcaggcaacaaagaacaggtctactcacccccaggctggccaggctcctagctgctctcatatcaaaagtcccaacactgacagctctcctttcagaagaagaattctggtgagtgtggtgtcctcatcttgtttcatctgtaagttatctttcatggtgctaacacacacatgcttgtggaagccaaggcactgaggctgaatggcccaaaataaagacaagtgcccactgtgtggggtggccagcaaatatctcaacacagaggcttgtcagcatccatcttcatactgtctaattgcttctgaagtaagtaaggaaagaaaaagaaagggacaggcagacaggcagacccagaaggtttctctgttgcatctggtgactgtaactcacagagtaaggaagcacttaggcagacaatgcccaaccttcctccagattggcaatgccaagggcttttttatgggcccttaaaattggttatcaaaggaaatgcaaattgagttcatctttgtcttgaagccatatgtcctctgggataaaaacaacatttttttctgttaagaatgctatccaggatttacttggttactacagcttgagtgtgcacaatgtgttcggggggcagtaaaaggagaaagtgaacactcagagttacaagtgaacctctatagtcttcagaatgagagaaaaacagtttgcaacctaagaagcagagatggaaaggaaacctactctgtggtgggacactgcccactttttcacagtggcccttactcatcttcctttatccccagagaatctcattagctatttgatattacttattgcctttcaattttttaagcaaagtttttctctcctcttaaaacagttttcttcctagtgatcctccaggtactgcttctttctatctacttactaataagacccaggattcttttttttcccttttctaaattcttctttctagtgtccagatggaacaaccaggaagaccacttagggatcccttatttttacgggactactattcctttccctaattatataactatctagctctttgcactagagtttgggaaggagccgggttcagcaatagcctatcagcaccagagactcagaacagcatctgtccagcctgaggttacaacaggttagttacaacaggtgatgttgacatgaaggcccaagggaacgggcaacaggacctagcatttgagaacaccagctttggagtcaagttgcctggacctaaattctagttctgccactttctagctatgcagactgtttgctcaatctttctaaacttcagttactaataataaaaaagggagggttatagggtctactgcataacattcaataagataatacttataaaccatttaacaccatacctgacaaaggtcagagtcaggttaaatgtcagctattttcattattaagataaggggatgaaaagcagtatcttagtcagtttggggtgctataacaaaataccaaagactgggtggcttctgtacaaaagaaatttatttcttatgtttctgaaggctggaaagtccaagatctgcaatggaagatggccctccatgaggaagtgggccctcaccagacactgaatcttcactgtgtctggtgacagcccactacctcatggagggccgccttctcattgtaaatgtacatagaggaaatggggagctagccctctggggtctcttcaataaagaaactaatcccaaccacgagggcccttccctcatgacctgatcacttctccaaagccccacctcctaataccatcaccttgggggttaggattttaacatgagttttggggagacacaaacattcagaccatagcaggatgaaggttaaagcaggtaggtttgtttgtaatagataaataacagttagtagtagatagataatagtagtcgtaggcagataaagtagataggttagtagttaggttgaagttaatatgggaagccaatagaagcatggtcaggatcacatggcatatacacatatcctatcctatcttgattctttacagcagggaaaacccaggattgggatgcaagacaccagattgttaataacagctaccacttattgagcattactacatgccaggaacaatgctaagtgttttaaacaacttgtttaaatacagtccccttagtactatgagtgtcactgttacatctctgtaatgcttagcacactgcctagcacatagtaggtatttagtaaatagttgttgacattaaaacattttgtagcactcctagtttatctcttttcaatatacataatttgcttgataagtcaaatgagaaggcaatattattggcatttgacctttagccacctgaagcacagtagaacatatgtatgtgatcaaatctattactaggatatttctacattggcgaaaacacttttctacattggtctagactgaaagaaatcagcccaagccaatgatgtgtcaaatgggatattatttagaaaaactgcttcatgttttacaggctcacaaagctagtctgaaaaatattcttcttggcaaatgtataacaaagtaattaaaggagtcaacattcaaaacagggaagtgaaaatctgaaaccggcactgagacaaataaaataaaagtataccttcagctgggtggggaaataccgattcattcagcagtcctaagagggaaaaatggaattccatcaagtaattccttttagtacattaaaaaaaaaaatctcaatatttccagtgtgaaaagattttataagtagcaaaaccaaagtttaaaaatcttcccagaaaaatttagatccaggcctttccccacccccatcctatttttaactattagtattttttttcttctttccgctttttttcctttttatttatttatgtattttttatttatttttattttttattattattaagttttaggatacatgtgcacaacgtgcaggtttgttacatatgtatacatgtgccatgttggtgtgctgcacccatcaactcgttttatcagcaatccaaagtgttgggtgactttagaggacaagtatcattaaagagcaactatatatggaaagggcttgccttggcttatctagcaacagacaagatattaagatgggcagcaaactctattttctctcagagaatgaggaagtagcccaaacaggaaggggattcttttctattttgtaatggttattgtaccagaaccatcacatcgatccatcaatgactctatgtttgaacacctatgaaaatgtccatataattcatagtgtaacactccactgagtgagcgcattaagttattgcgtgactccaatgaactttttttttcttggagtatctagctagctaaactaaatagtttactaaatagtatactaaactaaatagtttagttaccatttttggatgtggataggaagccacagtcactatagtaggtgacaccctactttaattcacctctaaatacgaacactgacacactcacacacaactaatcactcacattgtttcagtcatggtcaaactagaaaaagctacactaagtatttacaaaagaaaacatttaatccaggtgactggtaacaaagatgacaaatatgttaagtattaagataaaataaaaattttatcttaagtatgataaaatatttaagaaatcacatagaggggacatagaggaaaccaaaaggtttagcaacatcaggaagctgttgtcacccataaactacagggattaaggtagttttggcagcaatcactgggtagaagctagaaacgcactgcatctgttacagaggaagttagcacaatggaacagacatggccactcaggaagatgggcccagatacgaagaaaaaaggggaaaacaacccacttcttcctcccctctgcccataatcttgctggtgtgccacattggttaaacctagcaagatactaggacacagggaaatacagctttcaggtgttagtcaccctatggactggagcagagcaggaaaatggtatgaaatatatctgttatcaacaagccaagaactgctccccaccgccccaccaaacatacacacacagagataacttggtttcaacatcagaattgtcactctctgaatttgaagctaattgaatcagtgtaaaataaatgaaaccaaccagcctggccaacatggtgaaaccccgtctctacaaaaaaaaaaaaaaaaaaaaaaaaatttagccggtcatggtggtgcatgcttgtaatcctagctacctgggaggctgaagcatgagaatcgcttgaacctgggaggtggaggttgcagtgagcctagatcgcaccactgcactctagcctggatgacagaggaagactgtgcctcaaataaataaataaagccatccattagcaagacaatttaactttccaagtctacttgactctaagaatctatgatgtctttcaatatggtggaggttagaaaagacagaggaatagagacctcatgcttattatatgtgagaatcagtgtttaatgctttttgaacatcatatgactttatcctcacatcaactccataagtttattacagggttcaaggttataaagatgtatcaactctatttgataggtgaagaaactcaatgacgtgaatacattacccagcatagtacaataagcaaatattggagtctggttttacataatgttgggcctgacttaaaattttcactaacaacacacaatcagtgatgcaactaatataaagctgtagcctaatcaattggtttgtgttttactgcctgttgtaatgatgtcacgattggaaaaaggcagagaacaacctgaactaaaaaataattaaagggtgtatgacttccaaattaacagaagaaaactagaaaaaaagttaaataatcaaaataagggaataaaagaaaaaatacgtaaaagaggaaacattagaaggtacatagtgagatggtagatctaagcccaaatatatcactaattatattaagtgaactaaacgtaccagctaaaagacaaagattgtcagactagataaaaacacaagattcaacaatattttgttaacaagtaacacaatgaaaacagggtatcatttaaatataaaagagtaggaaaagatataccatgctaacgctaatcaaaataataacaatattaatatcaagcaaaacgtttactgaaaacaaagagggtcacttcataattataatgctttaaatcatattaaatatttattcagactaacttttggtagacctaacataaaatctttagaatatataaaggaaaattgacagaagtacaagaagaaacagataataatcatgaaactgggacattttatatatctcagtatttgatagaacagacaaaaatatcagcatggatagataagatgtcaacaacatgattagcaaacttcatatcatggacatacagagaacagtactgccaagaactgcaatatgagtatattctagtcaagcatacattgaaatttactaaaaattaccacatagtgagccataaattaagacaaaggcattctctatctttgttactgtgtttctgtgaggttttttctttctcttttttttttttttttttttttggtgcttgctcccagcccaaccttccatttgcctgtcttggtctgtgtatatcatttcaaagattttctgaaatgtatggtgctccttggtgagctgttaatttttaggactcgaacactagagagctggtttcaagctccaagtataggaggcagggctttcattgtttacaaggacccctaatgtcactgtcaatggtcttttctctgggctggtttagtcttactgagaagaatcctttaatcccccgttttctcatatgtaaactctggataataattgtttctagctcgcaggacactgtaagcattaatgagataatccatatcaagtgcttaaaatagttcccggaacagtgaaacattcaatatgtattagctattattattcagaacattcaactaccctcatggtttcaatattgctgattagatatgttgatgatgcccaaatttatatatttaattgcttcattaacatttccacttggatatagctcagccatctcaaacttaacataaccactcttctctcatctcagtaaacagcattgtcatgtttgcacttgctgaaaccagaatcccaactccccttctatgagttcatggcctttctcccccaactaagatggaagctactaggtggcaaagacattctctgtcatcttctcctttggcgttatgatcagtgtgtctctgcactggctgtaactgaaccagtgtatagaatacaatgaggcactgaaataaggaacaattgcaccaaattaacactgtagttgtaaaactgtattctttgaaggttcaatttgtctctaactccttgatcttcttctgttcccgttttttccatgggttttctttttcttgcttcaatccatcttcagttattttcagatagagcctcattctctcctccatttggattttgcttcatttcattttatttccatttcctcacgacattgctggtgaggactctacctattctccaattgtcatgccctgactgctgtttcctgggatcctgggcatcataagatatccttggattcttcacagcagactgttaaatttggaaatgtagactcttattcagatatttgtgtttttttctttcagactgcactgttaggcctttaggacttgatgttgtttattcttagagacttcctggggcatcaaaaacagcttaaaataattactatgtgcgcactggcatatatgacatccaatcgccctatgttaaactgaatttcaatgagttttctgtaaatgaatcagaaacatatggatttcatcctctctatctccacttttttaaaagcaggaactcagtatttgggtttcattgaatataaaatatttgaaactgactgagatatgacaaatcagggaagagaggttttcctaatttgacagccatcttgtctctaatattctagttagtaatgatgtgtttgttgatttctcgtcaacttcactttcctctgcttgcttctaagttttccttcgttattctaaatccctatttatccttctgcttcatccagccatcctataaataattatctgttgaccactactctgccttgcctgtgctacctccttggagggctatataaccagagatttccaacacattgggaaagtgccacaatagaggggcataaaacaagctttgaggagagggtaactttttgtccattttgcattttcctcccttttgtttgcctttcttttcactctcttcacaaagatgctctctgttttactttatttccttgctctgatcttcgtttctagtcttttttctccttgctaccatgaatgtttgtgtcctcccccaaccctgaaaattcatatgttgaaaccaaaatcccaatgtgatggtatttggaggtggagtctttggggatgattaggtcatgagggtggaaccctgatgaatgagattatgaccttataaaacagaccccagagacctcccttactccttccattatggaggtttacaggaaaaagatggctgtttatgaaccaggaagcaggccctcaccaaataacaaatctgccagggcctagatcttggactttccagcctctagaaatatgagaaataaatttctgtcacttagaagccaccccgtgtatggtattttgtaatggctgcccaaacataccaagacactcctgcgttttctacagccacattagctgctttccaattccccattgtatcaatgtttaggtccatctggcactgcatgtgcatgagcagcttaatgctttcctctacttgacttttatccattgtcctgaatggaatccccagagtctgagcctgttgctgctcttagtctgtgtcagtttgataggggtctttatttaattttaattttaatttcaatagtcttggggaaacaggtggtgtttagttgcatggaaaagttctttaatggtgatttctagttttcttttcttttttctttttcttttcttttcttttattttttatgcttttatttttgagatggagtctcactctgtcacccaggctggaatgcagtggtgtgatcttggctcactgcaacctctgcctcctgggttcaagtgattctcctgtctcagcctcccaagtagctgggattgcaggcacccgccaccacacctagctaatttttgtatttttagtagagacagggtttcaccatgttggccaggctggtctcaaactcccgacctcaagtgatccacctgccttggtctcccaaagtgctggaattacaggcgtgagccactgcacctggtcatttagtggtgatttctgagattttggtgcacccatcgcccaagcagcatacactggtacccaaagtgtagttttttatacctcacccccctcccatgcttccctcctgagttttcaaagtccattatataattcttatgcctttgcattctcatagcttagatccctcagtttagaagaggccttgagagagcaaagccacctcctaatagggtaaagctgtgtgaatgcattgaaatctccaattgcactgcacaaaatatgtggccaagactaatacaactctaacatggtgaggaattagtatgaagtgttaaattacataagtaaatagatacccagtagatacaacagtcagccactctgattaatgttgcctcctccaccttcataattgcattaacttagtaatgatgctctcaatcataaaaaacaagtgatgacataatcctttaaatagttttcctttaactactttggtgaattagtgtcattctgtttacctgcaccacattttgaagcattctgctaaagacaatataattctatcagtagtgaatatgacaagcaaaaaaaggagatatttgaggggcaggaatgtatagttatgagcattcagacaggctcgagtgctcataaagctcccttccatccacctacacatccccttgctgcgtcaagacttttaccatcccagaatgaaccagttaaataaatagctacagatctagtgctctcatgggagcacaaaaaaagtctttacttctgcaaaatttttcattaggtaattcacaaaattaaaatttaggcaaaattgaagaaaaatacatgatataagggagaaattatgttttattttaaacattttatctagcaatcataaatatagtgcttaactacttgacaggcactgtccaaatcatcttataaatattaagtaagtataattttcatgacaactgtttagtagggggtgtaaatttcataacaactcttcagtagctattatctgtaacttttagatgagaaaactgagccacagtaagattaagtgatttgcacatggtcacacacttttaaggggtagaatcaggatttgaacttagacataccaggccaggcgcggtggttcatgcctataatcctagcactttggtaggccaagaagggaggattgcctgagctcaggagttcaagaccaccctgggcaacatggtgaaaaacaatctctactaaaaatacaaatattagccaggtgtggtggtgggagcctgtaaccccagctacttagggaggctgaggcaggagaatcgcttgaacccaggatgcggaggatgcagtgagccgagacggcaccactgcactccagcctgggtgacagagtgagactctgtctccaaaatataaaaaaattataaaaaaataaatagacataccagctccaaagttcatgttcttaccgctccactatacagctatgctatggtagaaatagaagatgtgtggagtatttaaaaatttagaaattgaagtttaccatacaaattctaataagaacctaacatgttctagaagacatctgcctcaaaaagatcatatgtaaaatggtaatagtacctatcacatgagaagttgtgggatttaaatgagcttatatatttagcaaagagcctggcatttgctgatagtatccatttttcccaagaaacaaaaggcaaattgagcactgtgtgtgtgtacatgtatatattcatgaataaattggtggatggctgtatagaagactattataaataagaaaatctataaatgactatatttttcagattcaaagggagtgaaaagaaactcccctattgaggagaggaaatcaaagtcacattgttagacaaggatgtgggatgggagatatcatgaccatctgcaaaatacaatctaccacaaaaggttctatttctaatcctgtgaatgaccaacaaatgtttggattaataatctgaagttcttacagtgttgatcatcttgagtacacagcttttcttaatgaattaattacgtaataagcactagaattttaatttagctcctcagtatcaaaaagttttcctaacctgtgtgaattccctgttgaataactctcagtggaaatcagattcttacctttcactattgcatctgctggcaaccaaagcaagggcatatgacctgatctctgccacttcaacccccttttggtctctgaagcttgattgcatggcatcaagaccaatagataggcagatgtggccacagggctgcaatccagcaatgtaacatgagggaaagtgatatatgcatctccatcctcttgaatgacactaatgaacaaactcctttcacaaaataaaaatttaaaaaacccctctctttacaccattgcattctctcaatcattttaaattgtttggagagagatattttccttaactcttcttgggtaatactgggagaaattctgtctccctaaagcattaattttatttcaaacccagagtggaaagtacagacataattttttaaatcccaagtaattttttgttcacttgattgaaccccaagtgggtatatgtgtgtgtgtgcatgtgcatttgcatacatcacctatatattcacaaatattgggccagaagattcatattctcagtgaaattctctctgaactactcatgctatccctataactatcactttttttaaaaaagctaaatttgagcgtgtgatgctcattatgttattaaataattctttctaaatattagtaacccattccctaatcttttgatgtacctggccaagtattttgttttactgatgtaaactacgcacttctgacctatcaataaaggagcttgtgtcttcaactcctttctcctgtagtaggggtagatttatcatatttacctagtccttcctaaccagacaccagttatttgtgagatggctggtcagagttggagctgtggctaaaaaatggagagaaaactccacttgcttacatggagataaatagaaacaaaatgttcacatttgtcccatcagcctcatgagctatgggatatttgaaacctatcaagccgttggatggagtacttgttctcaccaaatacattcattcttaataatgaaaatttacatatgtgcaatctattattactattcaagatgcagaggttcctcttctacttgtaagtaatagtaatccatttcatttgtttagtacattacacttttcaaagcacattctagtaacttaaaactgtgtgaggtagatattatcttcattttacaggtgagaaaactgaggctcatagagaatatttgacttttacaaggtcaagttgtaagtatcagaaccatgatatgaaactacatcatctgactgcagttcagtaggctatcaaaactattcccatgttattttccattggattttgtggtcatccttcagaagccctttctttggtaaacaaacaaacaaacaaacaaaaaactttaaaataaagcctaacaaaggagtgtcaacatttaacattgaactcactggtcagaaacttcctggctcacaactagagatttctaaatgatggaaagagggcagttaacatgttgtgatgttctttctttcagccataacttttcttgtaggtttatagttatggtttggctgtggagtacaaaaacataaaacttaattgaatagaagtcagatcaaggtctttcaagctagacataatgtaagtcacacaaataaagatgaaccaacaaatttttaaaaattcattacaaagaccccagtggaaaacataaccctaatttataaaatctccctactgtgaagcatattttgtgtgacacacagaggaataaacccataactattactattgggaatgaaaactatatcataaaacttatatctggaggctcaaagtatgcttctgatacaaacccatgcccttcatacacacacacacacacacacacacacacaaatatttgggaaagactcagattttttctacagtggagcataagtaacaatgactcccccatgtaaaacctcttgccaagacgcattaaatacaacaaatatatcaaatacaggctgcatgtagagactcacgtctgtaatcttagcactttggaagatcacttgacccaggagttcaaggctgcagtgaactacgattgagtcactatactctcttctgggcaacagggtgaaaccctgtctctaacaaaacacatacacatgcatacatgcatacgtatgtgtgtacagttttccaccctgatttccattgtcttgtaagttgagtcccccttttattccgatagaataacatccatcattcagttttggaatgcttcaaaatgctactttgatactgtgttttgcccccatgctgttgtagttgcacactcttctccctatttctgagttaatcctgtcctactgtgcagttagtgagtgcattgactgtagataagtatttaaggcaagactatatagttaatatgagaggctgaataatggcatcctaaagatgtccacttcctaatccctggaatttgtaaatatcttcccttaaaaggtaaaaagggactttacagatgtgattaagaattccaagatgagaagattatcctggattatccagcttggcgagtgtattcacaagggtcctcataagagggaaacaagagaacatttagagagaagatcagcaaggatagagataacttgaataacagtataaaccagctagacttaacagacatacatagaaaactccatttaacaacagcagaatgtacattcttctcatgtctacatggaatattttccaggatggaccatatactaaaccataaaacaagtctccataaattttaaaagattgaaatcttacaaaatatcttttccaaccataatggaataaaacaattagaaatcaataacataaggaaaactggaaaatccacaaatatgtagaaattaaacaacatactctttaaactgggcagaaaataaatcacaaggcaattagaaaatactttgagatgaatgaaaatgaaaacatagcataccaaaacttaggagatgcagtaaacacagtgctcagagttaaatttataacaagctgtaaatgcctatattaaaaagaagaaagatctctcgcaaattgagaaccctattttacaccttaaagaactagaagaagttcaaactaaaaccaaagctagcagagggaaggaaagaatgaaaattagagcagagataagtgaaatggagacgagaaaaacaatagagaaaatcaacgaaaccaaaagttggttgtttgaaaagattaacaagtttgccacacgattaggtaagttcaagaagaaaaaagggagagaagatgcaaatcactaaaagcagaaataaagatggagacatgattactgaccttacagaaataaaaaggactataagagaacactatgaacaactgtaaatgaacaagttggataacctagatgaaatggacaaattcctgaaaacatacaaataattaaaatttgctcttgaagaaatacaaaatcagaacacttatgacaagtacagaaactgaattagtaataaaaaaaaatccacttaacaaaaaagagctcaggaccagatggctttgctggtgaattttaccaaacatttaaagaagaaaaacatcaatccttttcaaactctcccaaaaaatagaagagaacggaacattttctaacccattccaaaaagccagctttattcctcataccaaagtcagacagagatatcacaggaaaactatagttcaatattcctcataaacatagatgcaaaaatccttaaaatattagcaaaccaaattcagaaacatataaaaaggattattattaacaccaagtgggatttgccctaggaatgtaagattgtcttaatatatgaaagtcaattacttttatacaccgttgtaaagtagtaaaagacaaaacccaaatggccatctagtagaggcagaaaaaacattcaacaaaacccaacactgattcatgatgaaaatctctcaacaaaccaggaatagaagggaacttttccaacttgttaaagggtgtccatgaaaaatttttggctaacatacttaattgtgaaagaaaactgtgcgcctaagaaattaaatacaaccatattagaaagaaagaagtaaaactatatttgcaggtgatatgtagaaattcttagggaacacacacacacaatgtggagctactataacgattttagtaaggtcacaagttgcaagatcaatatgcaaaacttaattgtatttctataaacttatagcaaataaccagaaagtaaattaaaaaaaataatttcatttacaaaaatgaaacagagtaagatacttaactgtaaatgtaacaaaagaaactcaggatttgtatactgaaaactacaaggcgttgctgaaagtaatttaaaaatacatccataaatggaaagacattccatgtttatggattataaaattcaaggattataaaaattgacaagataattttaatatttaaatggcaatgcaaaagacctaaaataaagcaattttgaagaaaaacaaagtatacttactataaagctacagtatcaagacagtgtggtattcatataaagatagacctatatggatcagtggaacagaagtctagaaatatgtcttatgtttatggtcaactgattttttttttttttgagacagagtctcactctgttgcccaggctggaaggcagtggtgcatgatcttggctcaccacaacctccgcctccttggttcaagtgattgtcctgcctcagcctcccaagtagctggaattacaggcatgtgccaccatgcccagctaatttttgtatttttagtagagatggggtttcaccattttggccaggctggtcttgagctcctgacctcaaatgatccacctgcctcagcctcccaaagtgctaggattacaggcatgacccactgcactcagccagtcaattgatttttaacaaaagtgccaagacaattcaatgaggaaaggatagtcttttcaatagatggttgtgctagcaccacatacaaactttaattcaaaatggatcatcaatatcaatgcaagaattaaaagtataaaacatttggaagaaaatacaggagaagatttgtacggcctttggttagtcaaggagttcttaggttaaaaccaaagcacaagccattaaaaaaaaaatacctggtaaacgggactttacaaaaattaagagtgcttcagaagacaccattaaggaaatgaaagggcaacccacggagtggatgaaaatatttgcaaatcatatatctgataaaagccttgtatctagcctgagcatgctggctcacacctgtaatcccagtgctttgggaggctaaggcaggaggattgcttgaggccaggagttcaacaccagcctgggaaacacagcatctctccaaaaagaaaaagaaaatacccaggcgtggtggcacatgcctgtagtcttagctaatatgggagctgaagtgggaggatcacttgagcccaaaagtccaaggtagcagtgagctatgattgtgccactgcaccttagcctgcgtgacagagaaagaccttctctcgaaacaataaataaaaataaaagacttagtaaccaaaacagcatggtaaaggtaccaaaacagagatatagataaatggaacagaacagagccctcagaaataatgccgcgtatctacaactatctgatctttgacaaacctgagaaaaacaagcaatggggaaaggattccctattaataaatggtgctgggaaaactggctagccatatggagaaagctgaaactggattccttccttacaccttatacaaaaatcaattcaagatggattaaagacttaaacgttagacctaaaaccataaaaaccctagaagaaaacctaggcattaccattcaggacataggcatgggcaaggacttcttgtctaaaacaccaaaagcaatggcaacaaaagccaaaattgacaaatgggatctcattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaagcaaacaaccccatcaaaaagtgggtgaaggacatgaacagacacttctcaaaagaagacatttatgcagccaaaaaacacatgaaaatatgctcaccatcactggccatcagagaaatgcaaatcaaaaccacaatgagataccatctcacaccagttagaatgacgatcattaaaaagtcaggaaacaacagctgctggagaggatatggagaaataggaacacttttacactgttggtgggactgtaaactagttcaaccattgtggaagtcagtgtggcgattcctcagggatctagaactagaaataccatttgacacagccatcccattactgggtatatacccaaaggactataaatcatgctgctataaagacacatgcacacgtatgtttattgtggcactattcacgatagcaaagacttggaacccacccaaatgtccaacaatgatagactggattaagaaaatgtggcacatatacaccatggaatactaggcagccatcaaaaatgatgagttcatgtcctttgtagggacgtggatgaaatcggaaatcatcattctcagtaaactattgcaagaacaaaaaaccaaacactgcatattgtcactcataggtgggaattgaacaatgagaacacatggacacaggaaggggaacatcacactctggggactgttgtggggtggggggaggggggagggatggcattgggagatatacctaatccaagatgacgagttagtgggtgcagcgcatcagcatggcacatgtatacatatgtaactaacctgcacattgtgcacatgtaccctaaaacttaaagtataataataaaaaaataaaaataaaagacttgtatctagaatataaaaataactcataaagctcaatagtagaaacacaacccaattagaaaatgagcaaaataacatgtgaatggctaacaagcacatttaaaagtgcttgacatcattagttattaaggaaactaaaactacagggagttaccaatgcatatcaactaaaatggtatgtgaaaaaatggtatccttatcaattacttgtggaaatgtaaaatggtacatccactacccaaaacagcttagcagtttcttaaaaagttacacgtaaacttaccaaataacccagccattctactcttaagaatctacctgagaaataaaaacatatgcacaaagatttgaacataagtattcatagcagcattaccataatagccccaaactagaaataacccaagtgtctaacaatctgataaatgaataaatgtggtatatccatatagtggaatatttgtcagcaattgaaaggaatgcaaacactgatacatgttaaaatatggatggacctcaaaaatatggtaaacgaaaaaaaagtgagatccacaaggatacatactgtatgattccatttataggaaatgcacaaaaatgcatatttataaagacagagagtagatcaatggttgctggggctgggagtgtgtgagtgggtattcattgcaaacagatttgtgaggaactcagggaaaagttctaaaatggaaatgttctaaaatcagattgtgcttggggtttgcacatctttataaatttacttaaaattattgaattataatttacggtaaataaattattgcccaataaagctgtacattttttgtttaaatttttaagggaaaaaaaagccaagaaaaaaatttagatgaggttgttatttacacaggctactgtgcttacttttattgtagcacttaattatgctcttcaaatcagttatttctctgactttcccattggaaatgtaaacaggatcacaactgatggatttgataattgtcctttactgcattaggtatttagatgggggctacctttcttggccaactgacatctcaagcacccaccgctgaagctgaaagcagaaatcaggaagagccaggagattaaagagaataaaaggcatacaatatgcatatgaatccatgaagacatgtttcatggaactgttcaatgcatccaaagagcccagtgtgagaatcccactggaatgacagttgatgtgcctgccagtcaccctggggcagggaagtgataccagcctagaggagaagaggagggacaggcaggtgaaagtgagtagtgagaacaaaatgtgagcaaacaaccttcattactggcaatctgtgtgattccagaactggtatccaaccgatgagctgctggagacatgtgtttgtattctcaaaccccaaacatttgtttcatggtcctaaaacaacgaatcctacagctcactatcacatttcatagctctggggaaaaccagaaaaggacagattgggcaggggttcaaagaggaaatgtcttctgccaaaccgagtggccccacttcctctctgcgtaagagtggggtctgagatagaccctgcttccagcagtctcccagacaagacaaagggtctcacttgtgaatcaaagttcactgcaacagcacaacaggctgggacaggttcccatctcatccagactttccccataaaaggcagaggacagagtaaaaatgccagtcccaatatcctgtaaatgcctgtggattttgatgtggactggacagaggaatggagagagaaaggggaggtgaccctcacaggaagctaacgtttctcaagggcccacatgacaagcactattaggtacttttatttaatacttccagcaacactgtgacatgggcattgttataacctacattgttatacctacaagaaactggggttcaaaaatcttttttgcctgtaaaatagctaatattatacattatacctatatacaggtaagaatctaaggcttaaaatcttaagtgaccagtgttacacatttggtaagtagcagatatgggatttaaattcaggtccatatgaaccctgaacccctgttcctttttattacatatgccacactgtccaatcatgtttagatagtttaaaaacatgttcagccttttagcttaggctttctgatttcttgtttctggatgataataagccagccaaaagtcctcccgggaattcttttctccccaagggctggaaggataaaaacacaccactgtgcccttgaagcttcactaacaatcacaactataaaggctggagtcaatgctgagaggatattattaacaaatggctttagaaaaccttcagagggtttgcagccacccacatcatttgtaagatcttagggaagaaacctgatccagtaaatgactgggaataaaacaaaccctagtatcagaaatataaagggaggaggatcattgcctttagacaatttgctttattgtgaacaataaaaatgttccagttgattcaacaaaaaataataaaaaacaaggctatttttaaaaaggcatttatagcactgcggtttcatttcctttgcctttagatcttcaggctctcattctgagcagcagatgctgtcatataaggaagaccacctgctttccagggcatctctgcaacaaatagctttgagggagagagaagaaagatcacaggatgaaaaggaaagaattagaaaggggggaaacgggaaattaagaagttggcttaatgcacatcttctgaattattcaactgctaaaaagccgacagatttcttttgacacttgactgtctcactctgtgtctatatccatattccactttttaaggacctactttaagagaattctgtccatctgcacagcccagctttatgacatatttatctttctttgcacaatggaagcataaaaaatttatggaacatgggtattaattaaatggtattttagttcagggaagttgcccagcttaaaaagggctactaggagtgaatcctttgtaaagaaatatagttttggaaataaaaatagcccacactcactcactacctcccctcagcaaaatgacttaagcactgtttctgagtccccagatttctaaaagcttgttaaactcttattaaaagcaacaggtaatgacttgtttctgttgaattgacctcaaaggctaattgtttggagtgatctaggtccccacatgcaaggaaaagaagacattaaggaaatcattcacataattccaacccatttaacacactcacctgaaacatatcaataataaaagtgataacaggaaaatgtttacagttttgaagtctcaggaaacaatttgttctagatggtattttttatatatcaaaggtttctttttattaaacagatgttattttagattttaacaggttttaaaatctttgtcaaatatattattcatttctttgccttcttaaacagtgtttacttagttataatgcattccattaaacttccaaaaaagggtttcagagaactattacatgatattttaaacataatttgaactcttcatgatgtcccaggatgcttgcatcaaacactagtgacaggatggggctaaaataaagtaaggcccttaggacgataagaagacttggtcttcatattctgtggtgaccatatcctcctgtgttattttaattctatgtctgatttttaaatttttttcaacttttattttagatacagggtgtacatgtgcaggtttcttacatgggtatgctcccaggtaaggagcacagtacccaataggtaggttttctactcacactctctctccttctcccatctagtagtccacagtatctattgttcccatgtttgtgtccaggtgtactcaatgtttagctcccacttgtaagtgagaacatgcagtattttgttttctgttcctgcattaattcggtcaggtttatggcctccagctttatccatgttgctgcaaaggacatcattacattcctttttatggctgcgtagaactccacagtgtatatgtaccacattttctttatccaatccaccactgatgggcacctaggttgattccatgtctttgctattgtgaatagtgtggcaatgaatatatcagcatatgtgtctgtttggtgtaactatctattttcctttgggtatatacccagtaatgggatttctgggtcaaatggtggctctaaattctttgagaaattttcaaactgctttccacagtggctgaactaatttacattcccaccaacagtgcataagcattcctttttctctgcaacctcaccaacatctgttattttttgactctttttttttttttttttttttttggagacggagtctcgctctgtcacccaggctggagtgcagtggtgcaatcttggctcactgcagcctccgcctcctgggttcaagcaattatctgcctccatctcctgagtagctgggattacaggcgcccaacaccacgcctggataattttctgtatttttagtagagacggggtttcaccatcttggccaggctggttgtgaactcctgacctcgtaatccacctgccttggcctcccaaagtgccggaattacaggtgtgagccaccgcacctagccttcttgactttttaataatagccattctgactacaattttcacccaattattgtacctctttgaacctcttggctctaaatctgccttgttgggttcacagatcctaacatattatgattgttacccaatcctaatcaagcctccacactgaaaaccccgccttaaacaaaactctaaaactcttgcctcctgaacaactggtaacattcaagctaagtctctcaataaatgttttggggatgcttatattgccataaattggaaataaagtgattcagtggtattccctgggagttgctcttgcttgggggtgctggatgatgtctccgtggaagtgtcatgaccctaaaatataggggatttgtttcaactgtctgcccaaattagggctgaaaggaggtagcaatggccatgctctttctcatactaatatggacaagttttgaaaatgaactgatcctgctgtcagcctgttcatcttctcatggccctactcatttttctggtttcaatttttcatgtttattctgatgactcctagttctttatttccagttcacagctttcactgatgcatcaaacctacaaatataacagctgattagacatctccattggatatcccaagagtgcaagaaactcaaaatgttccaaactatactcatcctcttttcacctcccaaaactactcttgtttttcctactccagcaatgatcccaacatacgtttactttgataagcctgttatccttgactttttcttctcccttatccaagcaaccaccaaaatgtttgattgaaaacattacattaaaattatgtaaattcaactctacacactttgctgaacttagtaagggatgctttcatatgcacagaattacatcgttttattagcttttaagacatttttatcaaatgtaaattttcgcctcctatattgatttaaattttccataaagtactgctttagtatcaattggtctttcagtaatcttcccgtgacagcacttataagataataccatatataattggctatttaaaaaatatttttattataaactataaacatgcaaacagaaagtgtataaacttatatgtacagtttaacaaattgtcctaaagcaaatacttgtataattacaatgcaggtcaacaaacagaacattgctggcaccccaaaaccatccaggcatcctttaaagatcacaattctctttccctccgaaggtagccactatcctgatatctatggtaataattagtttcttttattttcgtcacctatgtatacatctgtaagtaatacagttcagttgccttatgatcttctttttacattttatagaaacggcactatgctgttcgcattattttgctcctgctttttactcaacattatatttgtaagattcatccatattattttatgtaaccaaagttttcttataaatgattatttacttatctgtctcctcagtggactctcagtatcattcatgtcccttctattcaccactgtatttccaccacttcctagtatgtgttcagaaaatatttgttttaaaaaccaaaaccatctgtatctacacaacttactgtctacattaacatgaccttattatgccaccgtcttcatcagtatgactttattattccaggaaaatctttgacttatttttattatttattatttatttcagaaacttcctttaaaagccctttaaatgaacattaaattgtccaactctttaatcaatggcatcaaacaattgaaacaacttcttagtctccgagattctttgaacctcttggctctaaatctgccttgctgggtgtacaattcctaacttactatgattgttacccaatcctaatcaagcctccacactgaaaaacctgccttaaacaggactctaaaactcaataaatgtctcgattttgctctctgtcttctgagatgcactaagattctgtcaaggtagtggctggcaattgtacaagtatttgctttatcaccatttattactcttatcattgtaaaaataagctcagctttgtctcataaacaggttgttttgattatattttcagggagccatcattgttcatacgattgagtttgtaaatgaaccaaagaaaccgcaggcagcatattcaggttagaaaggcggtgtgctttggcacagcacagcattcctgctaactgctaaagcatctaggactttgcacagaataacagcagaggcaaagtctttcatgaaaatcagtttataaaggcctgctacttaaagattgtactttatgcaagatcattaggataacctaagaatagaccctcagaacaaggtaggattaatgctcaaaaaccctctaaggatttacaaatagaccttcagaacaagattgattagcccaaaccttatgctttctaagaaaaggtagagagaatactcccagggtgtctgtacaaatatttgtcatggccagtgatatggtttggatctatgttcctgcccaaatctcatgtcaaactgtaatccccggtgttggaggtggggcccggtgggaggtgattgggttatagaggtggtttattatagtttaacaccatcctccttgatgctgttgttgtgatagtgagttcttgtgagatgttatttaaaagtgtgtaacacctccccattctctctcttcttcctctttggccatgtgaagtatctcactccctccttgccttccaccatgattggaagcttcctgaggccactctagaagcagaagctgctatgcttcctgcacagccttcagaactgtgggccagttaagcttcttttctttataaattacccagtctcaggtagttttttttataacagtgtgggatggaataatggagccagcaagtctgccaaagccttgagcagacagaactgagatattggagttccattcattagaagaggtaggggattcagggtttccattcatttccatcattactaccatgaacaatgccttactcttctctcaaagaattgtctcatgatcaaaacaacagtgcaatggtgagactttgagctcgggatggaggaaatgtattttgcatgtgcaatggatgtgcctctttgaagacttgagggtgactgtggtaggatgaataatgccccccaaaatgtgtccatgttctaatcctcagaatttataaatgttacattatatggtgtttcaggaaaaactctctcaaaccatgtttttcctctgctcataccaccagaacaattatcaacacagaagacgactagaggggaaaactgggtggtcttgtggaaccaagcccccaacctgtggaatccaacactatctctggatagacagtttcagaactgaactgtggacacgcagctggtgtctgctgcagtcgcaagtctgggcctccagaacttctgaccaatagtcttcaagttggggttcctacaacctcctctttgggtttaatttgctggagcggctcacagaactcaaggaaacacttactttggctgactgatttatcatgaaggatatttaaaagcatacaaataaacaagcagatgaagagatacagacggcaaggtctggaagggtcccaagcacaggaacttctgtccttgtgggcttagggtgtgccaccctcctggcaggtggatgagttgttctttacctttctgccagcctccacgtgctaagctctctggaagcttcccaaaccctgtcctttaagcctttcatggagacttcataggttatctatgattgaagcatggataatggtgtcaaaatgtgattggacaagaagtgtatgatgtaaacccagcaacgcctatctgtttagatccttcttggtctctctgtgcaacattccttcctccagagtatggggcaggaccctctgtgcaatgagggtcttatgacccacaagcagattagagtcttgccttgagtgggtgaaaggaggacaagagaaggtcagacagattttgtttcctgaagcctgcttctgaggcctaaagtacccgaggattataataaaagactgtaactccctgttatgggagttcttatctaggaactatggacaaaaccatatatatgtatatggttatatagcgatctatataatatattgtgatctgtatataacatataatcataatatcacatatcaaaagagactttgcagatatgattaagtcagatatcttgagatgggaagattatcctagattatctagttggcatgatgtaatcgcaatgatctttttaagagagatgcaggaggagtcagagtcagaggagagggtaatgtaatgatataagtagagagtagagtcccaccctttgaagatagagaaaggagccataagccaaggaatacaagaagctgaagaaggcaaggaaacagattctcccctcacagccttcagaaggaagcagacccgctaatacattaaccttaacccgctgaatctgattttggacttcagacctccagaactgtaagagaataaacatgttttgttttaagccactaagtttgtgctgatttgttatagaggttacgggaaggtaacacagagacatcacacacagccccactcactagattaagatactatttaattttactatggttgtattacaaatgatcacaaatgctatgactgaaaacaatacatatgtattatctccgtttttgtaggtcaggaattcaggcacaagttagcagggtctgctgttcaggtctcaccaagctgtgatcaagctgttgtctggggctggagtatcatctgtggcttaggattctcttttaagccatacttattagcagattgcatcttcttcaagctgtagaagttatggtgttttggggagagggtctctggcttctttatctttgacctctagatgatctgtttaaagggctcatctgattaagtcagacccactcagaataatgtctcttttaattaattcaaaagtcaactggtttgggaccataatttcatcttcaaaatcttttcacctttgccatataacataacctaatcacagatatcccattctattcatagatcccaccaacacttaaggggagggaattatactgggtgtgtacatcagggggtggaaatataggggaccatatcttagagttttgcctaagttttgacattttgcctaaaatgtcatttattatatgtaatgtaccattttaatgttttcagagatattaatatgtgtatatttaacttccacaggactcgttaaaactcattcaccatttccattttttccataaagtcttaggatcttaaactaaaattctcatccttctagagtttgcagaaaatctaatggagaaaattatttttctatatgcatatatgtatacattgtgtatgtatatgtgcataatactaatacaaacttcatatatgtgtgtatatttgtgtgtgtatatgtgcgtgtatatatatatatacacacatatatatatatccttgtggggagatatatatatatatatatatatgtatgtatatatacacacacatatccttgtggagaaaattattgttctgaagattaggaatcttagagaaaaacaagttgagaaactgagctacccagaattatgaaaaaagcaagacagtagaagcctggcatcaaaatccaggtctcaagaattctcatttgaagctctacccactgttccatcatataatcagtatttgcttctcagaaaacacattataacctctgtattagaattctgatttatacgccattaatgccaataatttccagcaggagactgtggtatgagtcctcacaaatgatagcgtttttccttcacacctccagggaagctttcattttctaacattatcaattaagcactaatactctgttctcattgctttgtgtgtgtgcctaagaaattgacatggcatcattgctcaatgcacacatactgtttataaggctcacatccttgccacttaaccatggagtccaacaatttattatctgtttcatttaggacaattaatggtattgctggcaaccattttgcagctataatttggcagttcttattaggtcatgcccagtagcctcatggaaataataggaagagaagaaggcaggaaggaaggaaggaaggaaggaaggaaggaaggaaggaaggaaggaaagaagggagtgagggagggagggagggagggacgggaagggggtgagggggaggggaacagcttttattttgtagttgctttattcaggtctctttccggtagaagacacaggtcaatatagatcaagctgctatttaatatgctgcccctatagtgctgtcaaggatctagtaagattagaatattagaatattttctaacattctaaattataaataatgcttctatttttctattatcatttgccttctcttggaaatcaggtttcctactgcaacagacaaaactctaggatatgagctacaggggctatggcttgtagtcctaactctgcctctaatatgttatgggatttttgtcaagttactctgaaccttggtttctgcatgtaagaaataatggaaatgtataagctccattcagctctaaaattctgattttctgttgaactaaatccaaatgaaattcagtatcttttttatgtaatattttttcatgtcactactttggcattactacttttattgctttttaacagcctggaaataactcatattaactgttaacagcaaagtagaaatgaaattgggaacaggaataatgataaaactgtcagccagtgagcaattagtatgtgcctaacaccatgttgagtgctttacatattttatctaatccttgggacaaatctctgataggattattacctccattttacagatgagaaaatggaggcttagaataactggataaccttgcaaagtcatattcctaagctagttagcagcaaagttcaaatgtgaatctgtgtcactggactccaaagactgtaattttaagcattaggcttttacatcacccctaacttgtggatggccaatcaagcccaacattgttagactgtagggtgacccaaaggggcaatgtggactacaattcacacctcacacttccctccttcaccctttttataggctatgagtaggagatcagatggcttgtaggtgtgggttcactcccttctgcttttaaattttacactccccaggatctctgtttgttagcattctcccatggcttgcttgaacaatcagggggggatacacttgcactactgcatccccaaatattcccctttactagtaaacactgctggaaaaaaatggcctactttctaccaccacctgccacccattttaagagaaattgttgtaaaattaatacagtcatccctcggcatccatgaggaattggttccaggacctctctcaaataccaaaattcatggatactcaagtccctgatataaaatggtgtcgtatttgcatataacctatgtacatcctcctgtatactttaaatcatctctagattacttataatagctaatacaatgcaaatgccatgtaaatagttgttacactctattgtttagggaataataacaagaaaaaagtctgaatgctttccgtacagatgcaatcattctttttttttctgaatatttttgagctgcatttggtgggattcacagatgcggaacctatggatacagagggccggctacatgacacataaaaattcaagactgagcaaaagagtcaaagcaaaaagttccctagaatttcacagttagatgagcattagaaatcatttttagttcctagatgataaaaaactagagagagctacctagtttataaaagtcacccatctactcaatgtgataggaatgagattggcacccagtttcttgactctcctggtgtgatgcttttcctactgccaggaagttctgattacagaagacagacacacgaagggagaacccctgtgacaatggaggcagggatggaaggaggccaattgcaactgccagccaagggatgccaaggagcaccagtaaacaccagaagctgggaagaggcaagaaagactctccttcgggattcagaaagagtatggtcttgtgacaccttgatgtaagcctccagaacactgagaaaataaatgttaaaccaactgctttgtgacactttgttgtgggagccctaggaaacgaatacagagagctaaagggaagaacaagttcctgggctgggggatagggagacacaaaggggcagatggagaaaagtgccaaaaaaaagtagttagattgtttccgtatcttgactattgtgaatattgctgcaatgcacatggggacacaggcacactgataagaaaatgtgatatatatatacatatcatatgtatatatatatatatatatacatatcatatgtgtatatatatatcatatatataccacatttatatatatttgtatatatattatataatgaaatattattcagccttaaaaagggggttctaccatttgccacaacatgaatggacatggaaggccttcagctaatgaaataaaccagacacagaaaaaaaaattgcatgatctcacttatatgtgaaatctttttaaaaaaaggttcaaatagagaataaaaaagtggtaatcaggggcagagcgtgtggtgaggaataaatggggagatgtaggtcagaggatacaaagtagcagatatgtagggtgaaggagtctagagatctaatatagaacacacagactacttaataaattgtattgtgttagggatttttgttaaatagatttcagctgctcttgccaaaaaacaaaaagtaactatgtgagatgataactatgttaatctgcttcactatagtaactatgttactatctacatgtatcatatataacattccttcataaacctcaaatatacataatacaatttatttcttaaataaaaaaaatgttttaaaacaaagtagctagaattccagaggcagttgtgttctacctcacagtcggcgctctacagtgtggggccccttctttagtcccaagagaagaccagctttcagatgagcacctgctgctactggctgcccccagctttctggggagctattagatggggagaaactcagaagtgcctctagggtctcatactaaacttgaccagaattaataccaaggagttaatcattctttgcaccttaagaatttagaagaagaaacctctatttacttgagaaagctcccaagagcatgtgatagttgcaagcttgacaactctgattcccaagtcatccctggtaatcctttctggttttttgattgcttatttcttctcagataacccgcgatagtgaaaaaaaatagggtgacttttctacccattttatctgtaaaacatcccttcccaagtgacaggaaaatatatcatagatgcaaactaaattagaactatattagaactagaggttaggctccactaaagagaatatgtagggaatgtgcagatgctggtgaggaggggcacagggtgggcacagggctggcacagctctgggatggggttgggggatactttctggtactggtttacacttggtctttcagtagcacttgagaaaaaaatgcttgattaacctataggctgcccctttttcttggaagagcaccaacgcagagaattccctgagaggcttcagtgccagactgtgcactccatagttgctgtaggaagtgggagcaactctgagcagaacctcctcatgagcttgtttctgttgctattaaaggactgcccaattcttccagcctccccacttccccacccccactccccaacccccaaccagagcaggtgccagagaagttaactagaatggcagcatcagctgagactgccctacccacttcagagcctgattcagtggtcagcataggtttctggggcttttgaccatctccccactgactgaagtgaactgtgagcagtacaagaacaagatggtcaggtttatcttgtctcccttccacccttccacaaaccagaaataggcttcaataactgtagctgtgtgaaagccacaacaatcccacccaggcaggccatgactgtggagaagctgcttccagaaccattccacccacctccatctcccttctggctactccttcagctctaagctgggcaaccatcctctttcttatgccttccagtttagctctgacctttcagagccccctctccaggttgccgtaacctaaagaatctttcctccaaaagaatgcctccctatcccaatcctcatcaaaaagcattccctatggcagccctcaatcaatacttaggaagaaaaagggacatagataaatagaaatgaagaattgtatgtgctttctaataagctttgtataattatacttcctggaatattcatgtcttagaacactagtaactttttgtagtggattgaatggtgacctctaaaagaaatgttcgtatgctaacccctagaacatgtgaatgtgacctacttagaaaaagagtctttgcagatataattaagaaccttgagataagatcatcctgattatccaggtgggccctaaatccaatgataattgtccttacagcagccagaagaagggaaaacacagacacagcagcagaggttggagttatgcagccaccagaagctggaagaggcaaggagggatgagagccctgctaatactttggttttggacttccggccttcagaactctgagaaaataaagttatgttgctttaagccacaaaatttatggtaatttgttatgacacccctaggaaaaaatactcttgttaaagttgcacagccatgcaactacctctctgaatgtaaacatacacagttttttgcattacttttcttgcaattttctgtgcaaatataaacatacatatgccttgcttttccttttgtttaatgcaaatgaaatactattttgttttcccacttattttttccatttaagatgtcatggacatactgcacattggccacaaaaatattaactcctccctggaacaggacatttagtttgtttctgttattttgcagttttgaataatggaacaatgacagcagtatacatatatcttcatgtacttggcaagcacagtatgtctgtgggataaattctcagaaatggaacctgtagcaactgtgaatgggagttcactcatgatttggctctctgtttgtctgttagtggtgtataagaatgcttgtgatttttgcacattgattttgtatcctgagacttggctgaagttgcctatcagcttaaggagattttgggctgagacgatggggttttctagatatacaatcatgtcatctgcaaacagggacaaagagaataaaatacctaggaacacaacttacaagggacatgaaggacctcttcaaggagaattacaaaccactgctcaatgaaataaaagaggatataaacaaatggaaaaacgttccatgctcatgggtaggaagaatcaatattgtgaaaatggccatactgcccaaggtaatttatagattcaatgccatccccatcaagctaccaatgactttcttcacagaattggaaaaaactactttaaaattcatatggaaccaaaaataagcctgcattgccaagtcaatcctaagccaaaagaacaaagctggaggcatcaggctacctgacttcaaactatactacaaggctacagtaacaaaaacagcatggtactgttaccaaaacagagatatagaccaatggaacagaacagagtgctcagaaataatgccgcatatctgcaactatctgatctttgacaaacctgacaaaaagaagaaatggggaaaggattccttatttaataaatggtgctgggaaaactggctagccatatgtagaaagctgaaactggatcccttccttacaccttatacaaaaattaattcaagatggattaaagacttacatgttagacctaaaaccataaaaaccctagaagaaaacctaggcaataccattcaggacataggcatgggcaaggacttcttgtctaaaacaccaaaagcaatggcaacaaaagccaaaattgacaaatgggatctcattaaacaaaagagcttctgcacagcaaaagaaactaccatcagagtgaacaggcaatctacagaatgggagaaaatttttgcaaactactcatctgacaaagggctaatatccagaatctacaatgaactcaaacaaatttacaagaaaaaaacaaacaaccccatcaaaaagtgggcgaaggatatgaacagacacttctcaaaagaagacatttatgcagccaaaagacacatgaaaaaatgctcaccatcactggccatcagagaaatgcaaatcaaaaccacaatgagataacatctcacaccagttagaatggcaatcattaaaaagtcaggaaacaacagctgctggagaggatatggagaaataggaacacttttacaatgttggtgggactgtaaactagttcaaccattgtggaagtcagtgtggcgattcctcagggatctagaactggaaataccatttgacccagccatcccattactgggcataaacccaaaggattataaatcatgctgctataaagacacatgcacacgtatgtttattgcggcactattcacaatagcaaagacttggaaccaacccaaatgtccaacaatgatagactggattaagaaaatgtggcacatatacacgatggaatactatgcagccataaaaaatgatgagttcatgtcctttgtagggacatggatgaagctggaaaccatcattctcagcaaactatcacaaagacaaaaaaccaaacaccgcatgttctcactcataggtgggaattgaacaatgagaacacttgggcacaggaaggggaaaatcagacactggggcttgttgaggggtggggggagggggggagggacaacattaggagatatacctaaggttaaatgatgagttaatgggtgcagcacaccagcatggcacatgtatacatatgtaacaaacctgcacgttgtgcacgtgtaccctaaaatttaaagtataataataataataataaaagaaatggaacctgtaggtcaaagggcatgtgttacctaattctcttccaaatgaattgttcccagtgtcactgtcacagggtttgagaggacctcaacagatgacatccacaattttaatcattactggcctatatttttcatattcctcagatatcattgggtggggatggaaagagaaatttctatgcctgaatttataacctaaacccaacataaatattctaattaatgttatttccctaacctaagggaaaatttcctcctcagatggattgtattgtagctttgttccctcagccctgatatgtactactgggttaattccagccatccctcatcacctttcaggggattctcactctaacctgaaaaatattttgacttttgaaatcctggcttgatgaggtgagtgaatttcatgcgctccatcaatcttatgccaaataaatttgtctatagcatgaggtagcttaagtctctgttccagttgactcagattttatttggtgattacttgacattaattgacaacattccaggaattaagaatacaaacttgataccctcaaccagagtgcttgtctgagcaggctaccgtatttttttgggataactcacccttattaaccccaattttgtatgcctgtgcattgtctcagttgtgtgggagatccaggtccttatcttctttggctaattcctcttcaggaaaatcacatggagaaagtgttttggaaggatccacatgaccctcttctccaagtttattcaatgtctatttgcagagttctgtcagtgatattcaaggtggcggatttgctgttctccaaatccactattctcatcgcatccttgccaggagcatggtggcctgtgatcccaccagcctcccatgctctgaggtggttttctctctgcatggctgctctgaggcaccatcaccagctggctgcctgtcagcagcgtgagatgtaaatgttcttgtgcctccagccctcctttaccacttcttgacattttgctgtaatctggaaaggaaagtggaagatgctctgtgcttcccacctctattccccatggtgggggagcaagagaggcagagattgtagcttggaattgatttcaaattatttctaaaaacaagaattttatattatgtgcaatttaccacaggaaaaagaaaaacaaacaacaacaaaaattaagacctggaagcactccattatcttcctttcaaaaaagctacccaaataaagcatttttaatataaacagtgtctctctcctctctgaattattctgtgtctcaatagagaaacacacaggcaatgtgccttttcttggcatgaatgccctgatttccagggtgctgataaaccattcagtgtcatactacagtgccggggtcattaagcatatctccttgtatgtctcactcaggcagcacatgattcaatgaggaattcagagcttctgaaacttttgtttccacctcaacttccactgtaccttgtgtgattggagtacatatactcaggggagagacatgatgaacaaaagtgcattgccaatacctttcattctttttagcctctcagcctagctacttgctctttggggctccagggaggactgcctgcatctccagttccaccttcccagcagttgcgctgcaccttacaactgaccaaatgagcaaatggatacgaaacagtggacaccatgcttttcatgccatagcccaggtctgaacagggacctgaaaaaaggtggaaataagtgagaggtgaggcagaatgccacaaactggctgggggtcaaagttggaagcaaaaataaccatggtgaaggatttcgatcccaacaatgtggcctcattaccgtgcttctcacatgctgtactagagatgcattagcagcgaattgccattcagtcaagtctgccagtgtctggaaatcattttaaataccatttagtagcatttagattattttatgataacacagtacccactgaaaggattattaagctcatatttgcagtggccagagaaaaaaataaaacaactcttcgaaagatgactcccaccattgccccctcagcaattattcatttagaagcctctctgcctacattagagcctgatataaattggcatatgctaatgcagggctctactgtgggtttctcctttaggagttcaggctctcattacctaccaattgatgcacaggatcccagaccccgtttcctctagttcgatgtcgctgttacactgttagctctgagccaaagtaatttcttttcctttccatatacctattgctcctttggtaatgggtttccagagcaatattgcaaataataacccaatggtcagagcttgcttgcttgcctccaaaaataatacctcattaggcagcagatcttggcttttcaccgtggagcaggagatttacaaaaagcatcatttctcatggcccacagaagcctgtaactcacttaaagaaaatagtgttgccaagttaaactggtgagcttctcagcaggtacctgaaagctgaataactaacattttaattacacaatcatgttgttaaaacaaattttcaagtagcgtacttcaagtgtagtggtgtgctagagttagttgatttgtcctggctagggagagccaatggtgtacatctcttccccactccaggttcaacgacctgatgtcagcttgggaggctgaaattggccataacaattgggaaacactacaaatcagaattcccctcctttcttcctttcttccttccttcctttccttccttcttttcctttcctttccttccctccctccctctcccacccctctcccacccctctccttttttctttcacagaacttattattaaacattcaccatatcccaccacctcagtgaactctccagagtgagacagttccccagacaccactgggtaacaagacctcattcattgctggaggctgaccatgaaagtagtctggctgttccctgggtagcaccaactctgaccccaggctcattatttctatgcaactcattcagttcagtttctacaccttcagcttctgacatattcccctagatcacaaccaaggggctttaacaatgaaagtaccatgagcctgattatgctcagttttgaaaaagaaaaaaaattcttcttttcaggaatctagttatgaaagatattaagaggttgtgtgtacagttgagggttttgagagctacaggagattgggaaaggattgcttctgttattacatctgtagtttttctgcaaaagacagggcaagtctcaaggtctgttctgtttgttttgttttgctttgagacagggtctcactctgtcacctagcctggagtgcagtgacatgatcacagctcactgcagcctcaacctcctgggctcaaacagtactcccacctcagcctccagagtagctgggactacaggagagcaccactatgcccagctaatttttaaaaatatttttgtagacacattatctccctatgttgcccaagctggtctcaaactcctgggttcaagcaatcctcctgcctcagcctcccaaaatgctgggattacaggcatgagccactgcagctggccccaaggtctgttttgaattattttagcttaaggctttaattattaatgaataaaaatttcattatgcaaactcttatcagtacttacattctaatatgaaggataaaggttttgatgggggatgtaagatctagaggaaagagagtcaagagaatgatgcttccaaatagaaatgttctcaattgttcattatttctaggactagcctagactataatagcgttgtttgactaacattttaattacataagcatgctgttcaaaatacttaagtagcatgaagagtacaaaatggaaagtaaattttctttctactcattcagttcaccatctcactgttacagctagtaaatggcaaaattttattgtattaatatatgtttccaatttacaatagtgtatttgaatgctaactatgctattgtatttgattattaaatattcagtatgagcccataatagtttccaaaattttttcaaatatgcttttgctcagacatacagacatcaaacaatgctcattagtattaaaaacctgacttgttcactacattaattttttttaaacctgtgtttttactgctttccctttggaattttttttccctccaatttaacctgaatatagtcgagcaaatgcatggaaagtgagagtccagagttgatttaacttctattggcaggattttctgcccagaaagatccatgctccctgcaaattgcacactgcttatctcccatgtcctccttcatcagagctcactggatgcataaaaccagatgacactgttgctcctccctctcagagaaactctttgttagagtcaagtccatcaaaaatctcctaatatgttcataatggcagcctttgaacatctcctctccagcaacaccaaggacccagatttggtccttgatattgctgttgttctttatattgctggtgttctcaaatagcccatcctccccattctccactgtttcatttattggaccacatggcccgtatttccagtgcacctgctcagggctgctcacccccgtctcctgggaccctgaggctcgagattcattgcatagcacaggactcaccttgagcccccagcctccaagccctaatgtgtttgtgtttgcctattatggatttctgactaaggagcaaagggtagaatcctgatcttgttatagtggcctttgctgtgtcacttccttaaccactggcctctgacagttcccttgtcaagagaagtggatgtgcccaaccgagttttttgataaacactactctggctgtggggtctcccctcacaggttttgtttttatcgtcacagtctgagtcttgtctcagcctcatgtatctatttctaggtcactaacctttgctcctctgttgcctctttttggtgtgcctcttagtttcttgtaccacttagttcccaaagcctaggaaatactaagctatttgagaaaattattatgcttttctttttgttcctgcccgtgagaaccttctcccagagcatctggaacagctgaagaagacactcactggtgttgcagttatatgcatgagccttgtcttgagccacacttacaagaggttatttgagtttttgacacacaggcccctacacatattcccatctatgctcttccctagaatgatgttgcaaggaaatgaccaccttcctaaatagaatacaactcagatacttcaaaggtggctgtgaagattatattttccatgtggaaatggcagctggaccatatatatctggctcttgcctgaattctgtgcagagctttatcctttctccccgctcttcccctcatgctagtctgaggattggaagttagagacagacattagttcattctggtcccaaatgtggacattaattaattcattaataaatatttattgagcacctactatatgccagacattgttctaaaccctgatgatactggggaagattcttgatcctcttcagcttttctatagtacagctaaaacaagaatggaatgtttacataagaatagatattaacaataggaacgtaaacagaagccaagaaatctaaatgatatggttttcaagatacacttgatctctggggctcatatatcaggcctcatgtgaaatctcagcctcaaaattagactcaccactcaagaaataatttgtgtaaatctgctctcaaagtatagatccaactggtcaaatctcaaagagagataatatttcctctctctaccatgaaagcctgtcttgttccacaggaggcaaaaattatataaaattaacatctattatttggatgttctagagctggcctttcttttttcctacttgattttagcaagatcaaaacagatgtgttggaggctggccaagatggctgactagaagcagctagtgtgcactgctctcatggagagaaatggaaggagtgagtaagtacaacaccttcagctgaaacatccaggtacatgcactggcattcatcaagaaaacaacccaacccacagagaatggagaaaagcaaggcaggacgaccacctacctgggagcaacatggatctagaggagcgtcccctacccagggaagcggtgagtgagtgagcgatccggggacccatgcttctcccacagatctttgcaaccccaggtcaggagatcccctcgtgaatccactccaccaggaccttcagtctgacatgtagagatatgtagagtcttggaagagaggcctcttaggttcacatggaaccacaggagctttagatacctgggcttcccaggaaaagtggctgcaactctggcaaatcaggaggttggacccccatacatactcctaggaaaggggctgaatccaggggctgagcagccacaggcggtaggccgcacttccatggcatctcacaggataagatccactggcttagaactctggccagccacaggtagcagctttacctccgcctgagatggagctcccagagggaggggcaggctgccggctttgctgttttgcagccttagccgttattgcctttgggctctagagaatcagaggcaactagggactggagcagtcctccgacacagtgcagcagctctatgaagacgtggccagactatttttttatgtgtgtcccagatcctatttctcttcactgggaagaatttcccggcctaggtctacaaccatccccaccagggttttccagtcagcagcagttccaaacctcctgggactgtgttcccaaaggggagaatgggccaccatcttcgctgttttgcatccttagctgttgttgtctttgggctttggagagtccacagtgactggaggttggagcagacccccccaaagcaataaagctactctacaaaaaaagggggcagactgatttttttatgcaggtctctgatcccattcctcctcgttgggcaggacctctgcatcggggtccccagcctccccaactggtgtgtttgggccagcaacaagtctgtaattccctggaacagagctcccagagggagaggcaggctaccatctttgctgtttcacagccttcactgttgataccttcaggtactggaaaatccaaggtgactagggactggaatagactcccaccatattgccacgccctaaagaaaagtggtcagactattatgtgggtccctgatcccatagcttctcactgggtgggtccccccagcctgggtctccagccatcccctgctggggctattgagctagtagcagctctgcaactccctgggatagagctcccagtgggaggggtgtgttgtcctctttgctgtttcacagcccttgcccttgctgtctccaggctctggtgagtctgcagggaccagaaactggtctggacccccagcacagaacacccacctcatggaaaagttaccagattgttctccatacaggtcccggtcccggtcccggtccacacttctcactggggagggctatccaacctgggactccagcacaaccactctgcctctgtctgatcaccacagaggcagaccagcatttctccaaggaggaaatcttagagtcaaaccacaacccctgtgccactgcaattgcagtgctactgccctaacagctctcagcctggggaaaggataaaaggcactacccaggcacctccagcacaccatagccaccatacaaagaggagtctagcccctcttccctgggaacccccactcccaatcttcaccaggcagggcccctagctcatgaccacagaacagtcaccccacccagagtgaacatgcccactagtagtgtcccagagtttccctggggagaggctcccagaggcatctgacagcccccccgccaccccctgcccaccactgccacagtagcagttctatccctgctacctttggcctgagggatacacctatgcttacggcaccccacagtcaccagaacttacagcacaccacagcataccacagaacaccacagcacagagaggagaccagtttctcctcctagtgagcccttgaccccctgctccccaacaagcgcaaccccaagctcacactggtagtgcagctacctctctccactggctgaatactcccagtaactgcagctctgtgtttctaagacagggcccaaggaggaacaaaaagcccctctgcccctttctctgtgttggtgctacccagctatcttcagactaaaaaaggagcaaaggccctaagtgccttatccacacctccaacaagcagcagctgacccaaggagaggaagccactctgtctcccatggctcctacccacactcctgctcattattaccagggagggaacccctggcttaggcccacagcacagagcccccatccagggctgattgtactgagtgattgctgacctgaatctctctggggtggagcccccaggagacaagaaaaaacccttggccacaaccacttctaaggttcctttctttgctgcttccaagttggggagggcacataagccctgagatcaccccagagctgtcgtgggtagcctgggagtgccaagttgcgatctacagccagcactcaagtgggagaggagcccacgctatcagagcattgagagggagcacgattgcaattggtgaagaaatataggggtataggggagccccacgcctgagcaagagtctaccaaccgaccactatagctaagcatcacctactggatcacaccgtcaaaccaaaagattcaacagcaaaattacctaacacccccacccccaacccccgccgtgaaaccaaagacaagggagctacaaagaccctgcacaaatccttggccctgtgaaaacatcaagaaaagaagcctactgactatacttaatctatattgcagttaaaggaacacccacatatagagatgagaaagaactaatgcaagaactccagcaactcaaatggcaagagcgtctgatgtcctccaaacaactgtacaagttctccaaaaaaggttttaaaccaggctgtgttgactgaaatgacagaaacataattcagaatatggataggaatgaagatcattgagattcaggagaacagcaaaacccaatccaaggaaacagaatcacaataaatgatacaggagctgacagacaaaatagacagtataaaacagaacctaactgatctgacagagatgaaaaacacaccacaagaatttcacaatacaatagcaaatattaatagcaggatagaccaagctgaggaaacaatctgagaaattgaagactggctctctgaaatgacagaaaaaaaaagaaaaagaaaaaaaaagaataagaaagaatgaacaaaacctccgagaaatatgggattacgtaaagaggtcaaatctatgaatcattggcattgctgaaagggatgataagaaagcaaacaacttggaaaacatattctgaatgtcattcatgaaaatttccccaaccccactggagaggccaacagtcaaattcaggaaatacagggaaccccttgcaagattctatataagaagatcatcctcaagtcatataatcagattttccaaggccagaatgaaagaatattaaaggcagctagagagaaaggccaagtcacctataaaggaaaccccatcaggctaccagaccacctctcagcagaaaccctacaagccagaagagactggggacctatattcaaaattcttgaaggaaaaaaaaaaatcttcaaccaagaattttatatctactaaactaagcttcctcagtgaaggagaaataagatcctttcagataaggataagcaaatgttgagggagtctgttaccacccggcctgccttataagagatcttgaaaagagctctaaatatggaaaagaaggaccattactagccaatacaaaaacacatgtaagttcacagaccagtgacattataaagcaaccacacaatgaagccagcacaataaccagcaaagacatggaatcaacctaaatgaccatcaatggcagattggataaagaaaatatggtacatatataccatggaatactatgcagccattaaaaataatgaggtcatgtcctttgcaggaacatggatggagctggaggacattatccttagcaaactaacatgggaacagaaaaccgaataccacctgttctcatttataagtaggagctaaatgatgagaacacatggacacaaagaggggaacaacagaccctggggcctacttgagagtgaacagtggaaggagggagaagatcagaaaaaaataactattggttactcggcttagtacctggtgatgaaataatctgtacaacaaacccccatgagtttacctgtgtaacaaacctgcacatatacctctgaacctaaaataaaagtttaaagaaaaagatgtgttaattgaccatttctattctttttctttcaacttgtatttgtatgctagcttttattttaatatgtaatataagcttggcccaactgtggttcatgggctgcttgaagcccagggtggctttgaatgcagcccaacgcaaattcataaactttcttaaaaccttatgggatttatgcatagacttttttattttttttaagctcatcagctatcattagtgttagtgtattagtgttagggaagccaaaagattggacacctccgctacaatatatttggttcataaaggttttagacaatagttctttccttttgcttttcttattctgattaaaaatattgacaaaaattgttcatattcaaggtgtacaatgtgatgatttgatatatggatacattgtatgcttattaccaaagtcatgttaattaatgcattcatcaccacccatagttaccatttgtgtgtgcagggcagggggatgaggacacaaaatttgctgtctcatcaaatttctagtaaacaatgcagtgttattaatcacggtcagaatgctatacattagatccccagaacttattcatcttaaaactgaaagctgaactcatagaagaagaaagtagaatgatggttgccagggactgggtggtaaggtgaataaggtgatatatggcaaatagtttcttttttatagaatgaaatcatggccaacataaataactgtcttagctctgtttaatgatttcttatgtgaattgtatttatataatattttgattcttactttatattttcagggtttttttgttctgttttttgttttttttagaccgagtttcgatctcgttgcccaggctggagcgcagtagcgcaatctcgactcaccgccacctccacctcccaggttcaaaagattctcctgtctcagccttcctgagtagctgggattacaggcatgcacgaccacacctggctaattttgtatttttagtacagacggggtttctccatgtcagtcaggctggtctcgaactcctgacctcagatgatccacccgcctcggcctcccaaagtgctgggattataggcgtgaaccaccacgcccggcctattttcaggtttttgggtacatttagtctccttttctttttatcttttttgagttactcttttttgtctgtctctttaaaatagtatatacatgagtttgaggttttgattctcatgaaatatttgtcttttaatacagaaatacatttaccaaaaatatgtaagacttcttgggtcataaactttgtctctcaaaatttctattgctccattatattgtcacatttattattatagaggtaacatgttttattcctttgtagaaaactgttgtttttctgtttggatgcttacggaacaatggttctaaaagtgtggtcccttggggattgttaatgggtacaaaaaaagtagttagaaagaataagacctagtattgctagcacaatagggtgacaatggtgagaaataatttaactgtaaattttaaaatcattaaaagtgtataacatgattgtaacacaaaagataaatgcttgaggtgatggatacccgatttactctgaaatgattatcatgcattacctgtttgtatctcatgtagcccataaatatatacacctactatgtactcacagaaatttgaaattaaaataaattaaaattttaaaaataaaaaaatagtgtggtccctgagagttttcacggagtctatgaggtcaaaaccattttcataatactaagaggttattttcttttaaggtgttgatatttggactgatagtccgaagcaatgatgccttgacaagaatcaacacagtgacattaaattatactatatgtccttatatattctatttgacaaatgggaaatactcataaggcacttctgcatcacatcacagaagaatgactatcttgaggaaaatcacatgggcaattgtttgagttgcaagctaaagtaaccacatttttctggaaaacccttttttacttgaaagaacaactaacagataaactatgctaaattaaacaattatttgtcagatgttttctttaaatgaactaaatgagcctgtcactacaacaaaaggaactgcgagtatttgtggtcaacgataaaatttaagctcccatgtgaaaaacagaattttggaaaactattaaccaccatggtgagcttgtaagcttttcaatagttagacttttctaatgaagtttgcaacaatattaacaagtgtgattttaaaaatttgtgaaaatagtatagcaaaaaagaaaaatcaccggttattgatgtactagatttgtgtatgtcttttgaacagttctagtttcaccttacacagaataatcaggaaaagtgtaaaaattcaaaagtgaaataaaaattttatcagttaaaaaaaatttgtataactaaatgtgtcaatgtttggaagatcttaattattcagggaaacaatgtatttccaaatgaccagtgtatgatgttaatatatataggtaaagatctatttgaaatggtaaaccagtggatttttctgcaactaagtatgaaaagttatttaatatttcagttttcatattataattaacctttcaaagttgccacttttcaagtttgggtgtagtagttttaaaatattaataattatctgaaaaagctattaaaaagctacctttccaactacatatttgtgtgatgatagatttttaaatatactttaaccaaaaaatattaaaacaaattaaatgtagcagatatgacatcctgttttctaagccaaacaatgaagagatttgcaaactggaaaaaaatccaatttttgttttgttttggaatagttttttcattaaggtatcctatctatgttaacatgtaatgggcttattactcaaatgaacacatattttcctaaattctcaaatttaatttctaatatggtaaacattgataaagataatctatgtaaacaaaagttatttggaacctgtgatggttaattttatccgtcaacttgattggcccacagggtgcctagatatttggtcaaacattattctgggtgtttctgtaagtgtgttttgggatgagattaatatttaaataagtagactgagtaaaccagattgccttttctattgtggatgggcctcatcctatcagttgagcctgaatagaactaaaaatctgaactttctccacgtgagagaaaattccccctgactgctgggacattgccttttttttctacttccagactcaaagtgaaacattggctcttcttggttgaacagctcactgactcactctgcagaccttaggacttacccatttccacaactgtgtgagccaattccttatttttatgtatctatctatggtatctgtattagttcgttttcatgctgttaataaagatacccaagactgggtaatttattaaaaaaaaaagagttttaatggactcacatttccatgtggctggggaggcctcacaagcatggtggaaggcgaaaggcaagtcttatatggcagcagacaaaagagaattgagaatcgagcaaaaggggaaaccccttataaaatcatcagatcttgtgagacttattcactatcatgagaacagtatgggggaaaccacctccatgattcaattatttcccactgggtcccttccacaacatgtggaattatgggagctacaattgaagatgagatgtaggtgggaacacagccaaaccatatctgtatccatccatccatccatccgtccgtccgtccgtccgtccgtccgtccgtccgtccatcctattgattcttctatggagaaccctaaaacagaatccttagtaatttttaagagtataatagcattgtgagaccaaaaatttgaaaactgttgttatagagtatgcaaccttgtatcatagtattaccaggtatcacacaaagtgagtctctttttatttactttaactcaatgagccaccttaatctataactcattctttctctcaggaatatcttcttatatgtatcactgattattgatttagtctcctatagggacactaattatccacatgttattgactctcctttccctgttctccatgtcaattatctttcctgtcatcggttttttctttttacttttctgtatgtttcaattctgttatactaatctttctatattttatacatctctcattgcaattatttctattgcctttttatcttggcattttatctctgaatctctttctgtttcatagaggcaatgggttctacttctctattgctcattccaaataatttcctggttgtttcttctggattttacaagaaaacattattttagaaagatacttttcttctcagttttttcttacattggagttttatttctttggcttggattgaatattcttttttttaatgtttctctttgttaatcctttagttgggaaattctttacaaatttttttgttatcgttctgttgttttgtttcattttgttttcagaaagcactgtggtttggtgaggtaattttggctctgttactgcctcttgtgtggtgattcgtctttttcccaaatctacacttggaaggcagaatgacatgcactgaattctaatccaattcccaatgactttcacctagttcaaacttactaaagaagtaacttctcttttccctacaacctgattttcatccactgtaaatcaatataatacatgataaacaattcttggcttacacctataataaatattcctccaatgtccaccctacatcctatacttggggattacagctatgagaattagctctgccaccaccatgattccctacctgcctcttgcccagttcattttgttggcctctatctctgtagatataataggatgattgggagcaaagctgatggacagagtactccaattgcccgataattcatcatatcttgaggtgaattctgagtaacttgtttttaatacccttcaacctgctttatattatagtcagcaaagattcaccaccagacagtggcattgagttatctaacaaatttagtcttcagtattgatatgagtctttctctttcttctatatctttaaaaatactgtagttggatgttgggagtcaatttaatgaagactaatagacactaatagtcactttgagatctctggtgatattaaaccagtctctaagttcttataactctgaaccctatgacatgagttctcctactgagaatacaaatcaaacttcttacaggttggactgggtatctgattctccctttaaggtcactaagacagtcccaatgtggttgctgaccaagtagaataatgtccagattggatccagggtttcagaatcttaaataattttttttttttttttttttttttttttttttttttttttgagacggagtcttgctctgtcacccaggctggagtgcagtggcgcgatctcgactcactgcaagctccgcctcccgggtttacgccattctcctgcctcagactcccgagtagctgggactacaggcgctcgacaccacgccgggctaattttttgtatttttagtagagacggggtttcaccatgttagccagtatggtctcgatctcctgacctcgtgattcgcccgcctcggcctcccaaagtgctgggattacaggcggagccaccgcgcctggcccgaatcttaaataatcttaagaagatggtaccaggtataaagtatatataaagtataaaagctgggggaaaagactcaagggtcaaagtagagaaggttacttagctatcaggttctgaaaataatcaaaggaacagatatgactaataactgactaataacactcaaggtcattcatttaacaacatttattcataaatattcattgatatcagactatattactagtgctcaaggcaaggaaatgtagaactcaaacaggaatccataataagatgagtggggaggtctagaacttttgttagaaataaggctatgatgcccaaactcttttcaggtgctgggttttttgatttcaaagaaatagaatcaagatagatactaagaaatacttctatggcattatatacttcttatctttccatttgatctcctttcattaccctctaggcccaaaccaaaggagccatgttgtccttttgaccaaagaggaaactggccttatgctccaaacataagaaactcagcattaggcctaagagacctaaaggcctttggtcagcttcccaaagatactaactggccacttcccctttgtccctgaagtggaaggaaacattcagacccatcatatccctttaacaagcatgccaggttataagcctgtatgcaagtgatttctggagaatccatgtttcacttgtgactgtctctttgtaaaacacaggacgaagggaaagatatggttaaatccaagtcaagctcctttagggaaaaatctctcacagtttctttactggtacaatgagtaactctggtctagtattttcagaggtgttcctagctcattctcttagctgttctgccactgattttagaccctgctctcctttcaaagtattgatttaggatatacacaacttactgaaaagaaagccagcaaaggaataaaagctttaaaacacatcattatgcagatggtaatgtatttgctgcctccactgccaacagaacaaaaagataaaggtacatgtagcagcagacaaatttagcttagtcactggaggaaactagacattacccatcaaagcatgataataacatggcataggtttcccaagggagattgtatagcttctttagtaggcttttgaaagaaatggttgacaatgatatttcttgaaacatgttaatatagttctatccagagataggagaaagtacttgataatgtcccctgcctatcccttgccatttgacgattacaaatcatataactgtaataactcattcatctggaaaagggcacttacctttatttccttcttctttaggcaacaaaaccattaccttttctgaactgaaatctgctcacaggttgctttttggtactgacttttctctttgttcaccagactgatgaaaatgtgtatatcctatacgttcttatagttgtaatgaaatccctgagctcttccttcaaaaacaatttttaacaaaaaaaaagtaggttccaggaggataaaaggaagacagattgttttgtgcttgtattaaaggccaggctctaaacacttcccaaaaatccttttcaggctccttccaggggatgaccaaacatcaaccctacataaaacaatcagagattcaagctatagtttttcctgcctccaaagtagactaacaagacttaactgcacttcctaggtacctcaattctataacttgttccattttattttgtagaaaatagctgcaatacataaggccttggtaatggtagaatgtcaataaggattttttttctccagcccccttctactgaaatatgcccaaatcccaccactcatgggaatttcacaagtctcctttaataaccactcacccatgagcatttcatgaagactttttgtgtcatgctgactatttttattactctctcttattatgaggcttatatccttttcttctcctattcatctttttttttcttttttagacagggtctcattctgtcacccaggctggagtgcagtggtgcaattgacagcctcgtcctcctgggctcaggtgatcctcccacgtcagcttccctgccatagctgggatggcaggcgcatgccacttggctaactttttgtgtgtgtgtgtgtgtttttgtttgttttttttgtttttttgttttgttttgttttgtttttgtagagacagggttttgccatgtcgcccaggctggtcttggacttccaggctcaagccatacacccaccttggccttccagagtgctggcattacaagcataagtccctatgcctggcctcctactcaccttttagttctcagcttaaatatctctttctcaggcaagacttcccagatgttccatattaggttagatacacttactacacaactatatacatctgaacccaggtgcatttctcttgcacatttctcatcataagtgcagatatttgtacaaggtctgcttctcattagacattaagttcatgaagatggaaggctttcatcaagttcactactctatttccagtatctaacacagtgtctgacacttagtgttcaacaaatgctttaaattatgtaattcattaataaattttgaatattccaatgctactactgataagaaagttaaaaatatttatttttactacaacagattcaagttgtcagtctgaatatttcatttcacagtatttatttaaattccttctacactgattattttctctttttaaggatagcttctggttttttgttttgttttttccatcctcctactacctgaccccctggcccttttatcttggaaagaagcaaatttcttacagacattttcttcctacaggtattgtggtctctccagaagcagacttaacaacaggtataaatacacagtggtaacttgtgcaagtaggcaaggctaaccttccttgaaactatggtctcatttccagaattttgcggaaaccctgccttcacccccacatctttctggtgatgataattccattagcaagtggagtgctgaatttcacaatcagaaatgtggttttaaatataaatcctagcaagataaattgtaattttatttaaatttcatttaaggtctcagtgacttctcatctgcttttctgtaaatatgtctgaaggtcggcaacgatgccctgggcaggcagagccaaggcagatgctggaggaatagaagtgcccctgcatcaacattttgctgagaattggacttactattcaagtgtaaccctcagagcctttgttcagtaccttgctgtagtgcaataacatgagaagctgccatgaaaaagtgctggtactttctatatagtgtctattagtggaaactgtttgccttggggcagatctttgttttcagaagacttattaaaacagcctccttagttaagaaatattaatatatagacattaattgttcttgtagaatagtatgagagaacttttgtggcttcctaaaggctgccccacccatacctcttggaagactaaactcagacatctctggggtgggcaaatttacaaaccaaggaggccaaggagtttccggggagaaaaggaatggagacctgacctttccctttgggaaagtaaggacattataactgctgatgacttcaaatggtatcaactcaggtctgaaaaaaatgttttttttaaggaaaagaaaaaagaaagataccaagaactgccactgaggaacttaccttaagggaagggagggtaccagtataaagaagtgatcccaatggaaactgtgcccttaccattgaaagcctgcctaaagattcacaaacactggagcctaggcctaaagtgacatgggacaaacacgtctgagcttaacagtggagagaaagatctcttttttctctttcagtgttcctaggagcctcctttataccgaaggacagagacagtatcattctgtgcaagctcttgtgtttacaatgaaacaccctgtggtagccacaaaaacaacatgatcaaaccttgggtactcacccatggccagatcagagtccctagttctccctatttctataaagagttggagcctaaacctaccttctgtagattgagtaagcccatggagaactaaggtttctggggtaaaaagtgtcctaagagagagactagattttctactaatctaggcagagatatgagtaaacaaaatgtggcacatatacaccacagaatactatgcagccataaaaaaaagtaagagatcatgtcctttgcagggacatggatgaagctggaaaccatcattctcagcaaattaacacaggaacaaaaaaccacacactgcatgttcccactcctaagtgggagttgaacattgagaacacatagacacagggaggtgaacatcacacactggggcctgtgagggggtggggggggaaggggacacacagcataaggagaaatacctaatgtagatgacgggttgatgggtgcagcaaaccaccatggtacatgtaaacctttgaaacaaacctgcacattctgcacatgtatcccagaacttaaagtataataatactttttaaaatgcactgcaaaaaaaaagacatttccaaaaaaaaaaagaaaatataaataagactggcagccaagatggccgaataggaacagctccggtctacagctcccagcatgagcgacacagaagacgggtgatttctgcatttccatctcaggtactgagttcatctcactagggagtgccagacagtgggcgcaggacagtaggtgcagtgcaccgtgcgccagcagaagcagagcaaggcattgcctcactctggaagctcaagggatcagggagttccctttcctagtcaaagaaaggggtgacagacggtacctggaaaactgggtcactcccaccctaatactgcgcttttccgatgggcttaaaaaacggtgcaccaggagattatatcccacgcctggcttggagtgtcctacgcccacggagtctcactgactgctagcaaagcagtctgagatcaaactgcaaggtggcagccaggctgagggaggggcacccaccattgcccaggcttgcttaggtaaacaaagcaactgggaagctcaaactgggtggagcccaccacagctcaaggaggcctgcctgcctctgtaagctccacctctgggggcagggcacagacaaacaaaaaggcagcagtaacctctgcagacttaaaagtccctgtctgacagctttgaagagagcatggttctcccagcatgcagctggagatctgagaacaggcagactgcctcctcaagtgggtccctgacccctgacccccgagcagcctaactgggaggcaccccccagcaggggcagactgacacctcacatggccaggtactcctttcagacaaaacttccagaggaacgagcagacaacagcattcgtggtttatgaaaatccactgttctgcagccaccgctgctgattcccaggcaaacagggtctggagtggacctccagcaaactccaagagacctggagctgagggtcctgtctgttagaaggaaaactaacaaacagaaaggacatccacacaaaaaacccacctgtacatcaccatcatcaaagaccaaaagtagataaaaccacaaacatggggaaaaaacagaacagaaaaactggaaactctaaaaagcagagcgcccctcctcctccaaaggaacgcagttcctcaccagcaacggaacaaagctggatggagaatgactttgacgagttgagagaagaaggcttcagacgatcaaactactccaagctacaggaggaaattcaaaccaaaggcaaagaagttaaaaactttaaaaaaaatttagaagaatgtataactagaataaccaaaacagagaagtgcttaaaggagctgatggagctgaaagccaaggctcaagaactacatgaagaatgcagaagcctcagcagccgatgcgatcaactggaagaaagggtatcagtgatggaagatgaaatgaatgaaatgaagtgagaagggaagtttagagaaaaaataataaaaagaaatgaacaaagcctccaagaaatatgggactatgtgaaaagaccaaatctacatctgattggtgtacctgaaagtgatggggagaatggaaccaagttggaaaacactctgctagatattatccaggagacctttcccaatctagcaaggcaggccaacattcacattcaggaaatacagagaacgccacaaagatactcctcgagaagagcaactccaagacacataattgtcagattcaccaaagttgaaatgaaggaaaaaatgttaagggcagtcagagagaaaggtcgggttacccacaaagggaagcccatcagactaacagtggatctctcagcagaaacgctacaagccagaagagagtgggggccaatattcagcattcttaaagaaaagaactttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaaggaacaaccagtaccagccactgcaaaatcatgccaaattgtaaagaccatcaaggctaggaagaaactgcatcaactaactagcaaaataaccagctaacatcataatgacaggatcaaactcacacataacaatattaactttaaatgtaaatggactaaatgctccaattaaaagacacactggcaaactggataaagagtcaagacccaccagtgtgctgtattcaggaaacccatctcatgtgcagagacacacataggctcaaaataaaagaacggaggaagatctaccaagcaaatggaaaacaaaaaaaggtaggggttgcaatcctattctctgataaaacagactttaaaccaacaaagatcaaaagagacaaagaaggccattacataatggtaaagggatcaattcaacaagaagagctaactatcttaaatatatatgcacccaatacaggagcacccagattcataaagcaagtcctgagttacctacaaagagacttagactcccacacaataataatgggagactttaacaccccattgtcaacattagacagatcaacgagacagaaagtcaacaaggatacccaggaatcgaactcagctttgcaccaagcggacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactgtctctcagaccacagtgcaatcaaactagaactcaggattaagaatctcactcaaaaccactcaactacatggaaactgaacaacctgctcctgaatgactactgggtacataatgaaatgaaggcagaaataaagatgttctttgaaaccaatgagaacaaagacacaacataccagaatctccgggacgcattcaaagcagtgtgtagagggaaatttatagcactaaatgcccacaagagaaagcaggaaagatccaaaattgacaccctaacatcacaattaaaagaactaaaaagcaagagcaaacacattcaaaagctagcagaaggcaagaagtaactaaaatcagagcagaactgaaggaaatagagacacaaaaaatccttcaaaaaattaatgaatccaggagctggttttttgaaaggatcaacaaaattgataaaccgctggcaagactaataaagaagaaaagagagaagaatcaaatagacgcaataaaaaatgataaagggaatatcaccactgatcccacagaaatacaaactaccatcagagaatactacaaacacctctacgcaaatgaactagaaaatctagaagaaatggataaattccttgacacttacaccctcccaagactaaaccaggaagaagttgaatctctgaatagaccaataacaggatctgaaattgtggcaataatcaatagcttaccaaccaaaaagagtccaggaacagatggattcacagccgaattctaccagaggtacaaggaggagccagtaccattccttctgaaactattccaatcaatagaaaaagagggaatactccctaactcatttgatgaggccagcatcatcgtgataccaaagccgggcagagacacaaccaaaaaagagaattttagaccaatatccttgatgaacgttgatgcaaaaatcctcaataaaatactggcaaaccgaatccagcagcacatcaaaaagcttatctaccatgatcaagtgggcttcatccctgggatgcaaggctggttcaatacatgcaaatcaataaatgtaatccagcatgtaaacagaaccaaagacaaaaaccacatgattatctcaatagatgcagaaaaggcctttgacaaaattcaacaacccttcatgctaaaaactctcaataaattaggtattgatgggacatatctcaaaataataagagctatctatgacaaacccacagccaataccatactgaatggacaaaaactggaagcattccctttgaaaactggcacaagacagggatgccctctctcaccactcctattcaacacagtgttggaagttctggccagggcaattaggcaggagaaggaaataaagggtattcaattaggaaaagaggaagtcaaattgtccctgtttgcagacgacatgattgtgtatctagaaaaccccattgtctcagccaaaaatctccttaagctgataagcaacttcagcaaagtctcaggatacaaaatcaatgtacaaaaatcacaaggattcttatacaccaataacagacaaacagagagccatgagtgaattcccattcacaattgcttcaaagagaataaaatacctaggaatccaacttacaagggatgtgaaggagctcttcaaggagaactacaaaccactgctcagtgaaataaaagaggatacaaagaaatggaagaacattccatgctcatgggtaggaagaatcaatatcgtgaaaatggccatactgtccaaggtaatttatagattcaatgccatccccatcaagctaccaatgactttcttcacagaattggaaaaaactactttgaagttcatatggaaccaaaaaagagcccacattgccaagtcaatcctaagccaaaagaacaaagctggaggcatcatgctacctgacttcaaactatactacaaggctacagtcaccaaaacagcatggtgctggtaccaaaacagagatatagatcaatggaacagaacagaaccctcagaaataatgccgcatatctacaactatctgatctttgacaaacctgagaaaaacaagcaatggggaaaggattccccatttcataaatggtgctgggaaaactggctagccatatggagaaagctgaaactggatcccttccttacaccttatacaaaaattaattcaagttggattaaagacttaaatgttagacctaaaaccataaaaaccctaaaagaaaacctaggcattaccattcaggacataggcatgggcaaggacttcatgtctaaaacaccaaaagcaatggcaacaaaagccaaaattgacaaatgggatctaattaacctaaagagcttcagcacagcaaaagaaactaccatcagagtgaacaggcaacctacaaaatgggagaaaattttcgcaacctactcatctgacaaagttcactgtagatccagaatctacaatgaactcaaacaaatttacaagaaaaaaacaaacaaccccatcaaaaagtggttgaaggacatgaacagacacttcacaaaagaagacatttatacagccaaaaaacacatgaaaaaatgctcaccatcgctggccatcagagaaatgcaaatcaaaccacaatgagataccatctcacaccagttagaatggcaatcattaaaatttcaggaaacaacaggtactggagaggatatggagaaataggaacacttttacaccgttgatgggactgtaaactagttcaaccattgtggaagtcagtgtggcgattcctcagggatctaaaactagaaataccatttgacccagccatcccattactgggtatatacccaaaggactataaatcatgctgctataaagacacatgcacacgtatgtttattgcggcactattcacaatagcaaagacttggaaccaacccaaatgtccaacagtgatagactggattaagaaaacttggcacatatacaccatggaatactatgcagccatcaacaatgatgagttcatgtcctttgtagggacatggatgaagttggaaatcatcattctcagtaaactatcgcaagaacaaaaaaccaaacactgcatattctcactcataggtgggaattgaacaatgagaacacatggacacaggaaggggaacatcacactttggggactgttgtcgggttgggggaggggggagggatagcattaggagatatacctaatgttaaatgatgagttaatgggtgcagcacaccagcatggcacaagtatacatatgtaactaacctgcacattgtgcacatgttccctaaagcttaaagtatagtaataataaaattaagaaaaaagaaaacataaatgaaaataatttttaaaatagtcatgtgccatgtaaaaacattttagtcaacaatagagcacatatactgacagtagtcacataagatgataatgcatattttaactgtaccttttccatgtttagatgtgtttagataggcaaatgcttaccactgtgttacaactgccttcaatattcactacagtaacatgttgtacagacttgtagcccaggagtgacagagtattccatacagcctaggtgtgtaataggctatactgtcatctaggtttgggtacgtatactctctgacgttcacagacaatgacaaaaaagtcccacatttctcaaaatttatccttaagtgatatatgactatgtatgtaacctcaaatctaatgcagactagtgaacgagattatgcagaaaaaaattaacatagcaagcctgagactgctaccctcagaaagacctgcttgcaagctaagcccctggctggcatctagggacttgaatttcaggaatgtttccacgaccctaactgacaagagtggttcattgtgcctaaactgcaaatggcttatgccgaatacttgcttcccttctgcaagtctcaagctttagtatatgctaagtagagagtgtgtatgtgaccagcccccagtaaaaatcctgggtactgagttcctaatgaacatcccttgggagatgacagttcacatgtgtcatcacaacttgtttctggaggaattaagtgtatcttgcgtgaatactgggaaacttttggaaacttgctcctggtttcctctggagtttgcccatacacctattccctctattgattttgctttggatcccttcatggtcataaatcatggccatgagtacaactacatgctgagtcctgagagtcctcctaggtagttaccaaacccaagggcgtggtctagaggaacccaacacacaaggagagcacacaaataataccaatcaaatttctttcagtcatatgggatgccactttttcaacttgattctggaattttagctggatatttccattaacatttttctttaaagatttcctcatgtttatgcagttattgtcttctttttacacaaagaaactgtgttcttttttcttacatatatacagggttaattttttatcatattaaagctttctatttcaacgtcaagtaatctgaactgtagggattttagaagaaatctagtactactcactcatttcatgaagaacctgagcccacagcggaagaaatttaaggcttcaactggctttaaaaatgagccctctggatatgtggggttttgtaaaccatttaaaccctaaacataaggtcaccatattatagaatttttagttgctatattaaagcaagaaaataattgacatgtagtatattttatagcaggaaattttgcttttgctctgaagttgacccaattgtgttaggaattcaagaaaatctgttgatatgtgatatcaacagtctaaaagcttctgtaaataatcaaatcaacgccaaaataaaatctcacccaaagtagtccaacttctttcactaaatgcacttttttttttcactcttacactaacttaagtgattataacaatcaaaggctgactctgtgtactttaatcatattacagttttaccagtctcctcttccttttcttggtctccaaactacaggaaggcaagtcttctatgccacccagagtcagtaaaagtgtggctaaaaagtacctattgttactagatcttctctttggtgaattgtcttgactcttattgatattagaattaaattttaaattattttaagggaaggaaaaaaatgttgatccaatgaaaattcattttgcatccaatcatttgaaaaattatagtttcatagtgatctttccttcctctggttttgaacaagatttatgaaaaacacaatactatatttcaccaattctaagactgaaatatgtttttatcaaattttaacatctctcaaatgaggatccattttacaatcaatggcatgtcataggtttaattggcagcactttttttcttggtagtatgtttaaaaaatagcatcttataaatatacttgatcataaggtgaaatatggtagatatgtttaaagcacctgtgaattcaagtaaaatgtgctgctggatatcttcctgtcacccttctagcttcactttcccttttccatcttgctagtagccctgggaagctgacttatggtggatggcatcaacctggttcccttgccctactgcatttggttcgatttggcaaatgggaggcaccggtaggagtgggagagcaggaagagggtgacagagacatatattcctatccctcacccattagcttctacagggtcatggaggttagccagatctccctactgaatgcccaggctttgctgtcagtccagctatccctctccaggtgttaactgttctctctccttgcctcttgagatctagggttagtgccctctccaggtgttattagcctagaggcactgcaccgtctcttattgcttttctaaacaatgtctgcatatttataaataagccctttattaatctcttctcaaatttccaatttgaatatgccatctgtttctaccagggccctaactgatacaaaagtgctttaatcctttcttctcatggagcagcagcatctatatcagctgagagcttgttagaaatgtagactcctgggcccctcctagacctactgagacagaatctgcatcttaataggttccccaaaggactgggatggacattaaagtttgaaaagcactggtttaacacatcagtagatgtaataaaatctagcatcagaatgttaatggcttattaagagactattatctggtccccattgtccactgggggatgcttctccagcccttctttcattatttcaaccaaaaagattaaaaaaaatctaaaatgaaaatgttcttgtttggaaaagttgaagaatcttgtgtaaagatttgttgattttcatcttcaaaataatatcattttaaaatcagtgaacatttggaagaaacagaggaaaaccacgcttccagatatagttttgaataataactaggtccacctatgccaaacaccattaagaaaatgaaaaaaagtagagctaactggacaaaaatctttgtcatattgcataaaattattggtaattggagcctcatttgttagcactaagctattcatattgatttttctatctctgcaaactggaagtttgggacacagaatgaagaaataattgtaaacaagatctctctgcctgaaggaaaaaaaagaacatttcgtcaaagtaagaacacaatcctcgataattttcgacacttgtctggctgcagaaagcaaggccgaatctgcaggaggctttaaaaccctgtgaatttgctggtctgtttaaaacacttcacacattattcaaaggaaaaatcagatgtgctatgtatgcagatagacttaaagccttccttccaggttaaagaaatttatgggaatgcagtttaagttattcatcctctttaccataaaagattacctcactttgcaccaggtttcttgaaaataatctgaaacttccccatattaaaggaaaaatgtttgatttatagcttgggtttaaacctataatgaggcattccattctgagtgatctcatatactcaaagcaataataaccccagggtgtcagtgtacgggaagccctgcctagatggacattctgtagggtctgtgtcagccctttttctccctgctcagatttgctggggagtgtggttcctggggacccgagaggtggcttgtctgaaggcgaatcacctaatttttagtgtgtcaatcttgaacagcccccatgacttctaccctcaccagccaccccccacctcccctgccctaccaccatctttcttttatctagttggtagagtacaagaaaacaaagttaggtctcccatctctgaacgtcagactaacaatcatgtggtgagagacacacggttagggctggaaaaaacaaagacacaagtgaagcaagtaattctgggttcaacttgtggctctattacattagctgtttggctaatgtgacatgcctggcagccaccctaccatgagctccatcctcagagttttggggcatagaaccctcttttgcaatgcagtatctccatgtctttttgctgatctttggccaagtcatctggggctctcccccaggactggtcaagaaatcactccaggtctttcaaaccccatagttctagggaaccaggcagcatggcatggtgatgaagaacagactctatgcccgcactccctggagccaaatcctggctgcaccatttaccagctgtgaaaagtgacttcaattctctgtgcctccatttcctcaatggaaacagaattattactgttcacaggactgtttgagcattaaatgattaatagtaaaaagcacataaaatagtgcttggcaagtaaaagagagctatttatatttgttatgatgatgattattatgttcattaaaagtagattgccagataaatatcttgacatgctgaaacttagcttcactagtttttaactgaaatgtccactttttaaattttggttaatatttctataattattctatattggttataaaaatttgtaaaatatggcattattaacattttggtatatttgctttcaagtcattttttttctctgaacacgttgtgaaatgcatacatatgtgtatccattatattaaacagcatatatatactcttgccttttgcctattttcaattattcttcataaactataatgctttgatgaatggtcttctatataaatttttatgcactgacttcctctttcaatcaagatggagtaactgcattcagatttacatttccacataaaacaactaaagcaatcagaaaaaaatataaaacaatagtttcagccactgaacaacaggcagcttgggatagcaatccctgagagaggggaaacaaatgaggtgaaccctatgattgcccccactttttgcctggaaagtgattccagaccacatcgtaggaaaagagaatccagatggcagccagtggttttcctggtttgaagagacaggcttgggagttctgagaggctgaggttgattgagtctgcatggcagtgttagagaagagagagctgaacagaaagagtggtccaaagatctgcgcaggaacccccatttccactcccaaatagcacgtttgtgtgaggaaactatctgaggtcaaggaaagaaccaccgcaaaggggacagatgaaataattcatgcagctcacacagggccaggaaaagtctatgttccctctaccatgtggaaaaaccttatgacacctaaggtatcaggaagagtgcttatcaggtaatcacctcagttgtggagctaaactagtcctatgctaaaggctgctgcggtcccagctagtaaagcctaaagcaaggtgtgaaaggacaaactgtttccaaggaacttcatgacattactgctaatattttcttataaatgaaataaagaaaatacccaagaataatgcagtacaccatcccaaaagttccaaggagaaatatttggaagaagagaagcctatcttgtcatggaggaggggatattctggcccaataatgttaattaattcatttattcattcattcataaatataatgagtatctaccatgtgctatgaatctccacgcattttagcaccaaccagtggggtcacgcccttctccaaattccattcagagagctagtgctcagtcactatttgaggaaccaggatatggcccaattccaaaacaccctctggccagcctctctgtaagatgctgtagggacaaaagaaactttccttctacccctgaaagcttgagaatttgattctataaaacaaattgacaaaagacggactgacaggggaaaagacatacaaatttattaaaatgcaagtgcacagaagtcacacaaagtatgaaactcaaagaaaggccagaaggttgaaacttaaatacgcttttcatagaggagaggaaaatgggggttgtgggaaattttagaggaagaatcaattaattttaggggaaattaatgggcccaaagaacatacaatagcctgggacaaagttcctctgggctctggggaaagtggcagcaagttatgggaaggtgaggggcagaattgcactgcaaacaaaggttatcttatcatgcagataaagtgtctcaggtaatgtccctcaggagaatagatgaaattctgcccagattggtaaagggagaactttaatttcttctttggtgatgaatcttccctggttaatggagatttcgggcaggagattgaaggcaattgtgtttcttttggaagaactaccctcagtcagatacggaaacgtcaaagagaattctttcctgtgcttgtggggagaaacaagggaaacttagaaagaccctgattctgaggcagtttccaagtcacctccaatttcctttaattcaaagtacccagcaagccaaatcatcacactttagggtattgttttctgagccccaacaatgcctgtacaatgaacagaaagaagagtatccaatgaacacgtcaaacttgatttcttaagatatgatcaaattgtgcttcctttgaaggcttgatttatgctaagccaacaaaaggatctgccggtgaagaacaccctgttatgaaactcactgacacactgtgtccaaggcagaatacattgagagctctgcttttctcctgttcctggatcacacactcaataaatggactatccatagtgtgttgaatttctcccatcttcttcattccaaaattggctattagatggtttcaatttgagacaattttaagcaatgattgcatcagactagaatctaattggggcaaagtaatttttggcaaaatcccaaggcaagagatttttttatctgagaaaattatatactaaggctgccaactcacaatggaaatcttaagcagcattaaacacaattctgccattgtccatttctatgaactgtatttggtgagaagccacacaggacagggcagaagttactgggaattattctgaagttgtctcaagaccaaaaagtaagatatgtgccatttgaaagaaacttaataatagactctagtccattttcctaattcaggagcccagcatgcaccatgagtctgttcaaacagctctcacaccagaatgccattctcatagctctaaatgtatccagacctttgacacttcacttattcaaaagcttttgctgtctgcttaggtccttatggatcttcctcttctctgaatgcctgcagatcttagaacccttaagcactttatgaggtgtggtttcaaagaaagcattcattgttctctgggcattctgatagagggtgcccagaaaacaagaccaggtcctatgtttctcttgaattcatcacatcatccatcataacaacggattcagttcagaggctaacttcgctcttcgtagttctccaatgggctttcatagcatcctgtgcttaattctttctcagcacctaccatactgtgccgtcttttcaatgcttctgtctttcaattactaaatgagagttcctttaggcctgagatcatgtctaggatgtattaatattcccagaacatactgcaaagtaaaaattcaatgcatacttatggaatgtgtataaatgagagaatggatgcataaagaaatgaattctagaagctcagtaactacttattgatcagttcattgactctgaggcaagagagcagaagaagagttgtttctgcgcttaatgaaagttgaagataataggtaacttagatcatccaattgtaataaaggagagaaatgagaaacaaaagcagccacagtcaggttaagccctgttaataatcaaacataagatcagtcttgcaagcatactagctttcatcttttgaacaattgtatgatctttccactcaacccccaggaaatatacctctactactttggaaggaaatccagtctctcaccttcatttcatctggcaggattaggctagtaatgtattttggcagtgactgagagccccaccgactacgccatcatcatgcccagccaaagataacatctccttcccttgtaagcaggtgtggtcagacaactaggttctggccagtggggtattagcagaaggaaggtatatgacttctcgaaaaattcctcaaaataaagaagtatgttcttttcttcctttctttcctgtcccagaagttgcaatgtggaggaggacagagcaacagcatggaaggagactgtatctctgatatcaggctacatactagcctcttacatgaaagagataattctgtcatttttttcatttcatggtcttttgtaacagcagcctagctatgtctttactatgacaacaagaaaccagctgccacgtttgtatgtaataaacctgctaagagagtactggagaaaagatgaggaagaaaattcacctttttaaagtgtctaatataaatgcttttaaaagtgccttgtagacaataggcagtatgctaaatgacaatctaacaaagtacttattatgtttgtcgctttaaaagtgaggaaactgaaactcagagaagtcaactagcttgtacaaggtcatatacctagtaaacggtgccaggtctgtttgattccaaggtccatactatttcccctttacaatagcaataatagtaattgctaacatttactaagggcttattatgtgtcaaaacttatgctgagcattatacatgaattacctcatttaattctcctgaaagtctttgaaatcagtatactattacactaattttacagatgaagaaagagggcatcagagttgttattaatattacaaataactcccaaggttattaagctagtaagagtcagtgtcatactttaagcagagtctgactgactctagggctcaagtcttaccaccttcagcttaactatgagcacatctttatattaaattattactccattatagaaggaatgtctagtgcccaatctgccttaggataaagagtaagtcaaccttctgaacccaagagtttaatatgcatattgtggctcataggcgacttatctacccctgtgtagagctggtgagaatcgaaagaaaaaagaaacttcctctttaattatttattgcacaagaactacacaataagacccaactgccactaccagtatgtaccttgctgttatcagctgttaatttaccaacccagatcaatcagtcattgcatagaagttgaaggaaattcattatacatttctgaacaatttaagtttaattctgctgaaattctaccaagaaactagaaacattatgaaagacgaataaaaaaagacataaatgaataaagcttccaggggcccctgactgatgcttgagagataaccaacaagttttgttggacattgtggattcacttcttatatttaaaaaactattgatgctgttcttaagtttttttttattttttattttacagcctatgttttaccaacaaaaccttaggtatttatatctacaattcaacctggtatttatttctgaaaaatcagttaaaagtaaaaaaagaggaaaagaagcatatgaaaatgaaaatcattttcaaaagtgacctccgtaactctaataacacaacctgataaagacattagaagaccaaaaataataggctaatatctctcatgaacatagatgctgtggtaaacaagtatagggtagtcttgcctccttgtgttcatgccctgatatcatcttctcccctcccttgagtgcagatgggtactgtgacttgcttctaaccaataaaatatgtcaaaggtggtgagatgtcactctcatgatttcatcacattatttaagactatgtcttgctaggagactcactccagagaaatgtcttagctggctttgaagaagtggccatgttgggaggtccacatggcaaagaattgagagtggttttaaagaaatgaacgcagccttcaagaactgaacgcagccttcagacaacagccagcaagaagctaaggccctcaattgtacaactgtaagataattatactaataacctaatcaagcttggaagcagatctttgcttagtttagccttccaacgagaatatagcatggccaacacctggactgtagccttgtgagactctaagcctaggatccaattagactatggccagctcttgactcacagaaactgtgaggtaacacatgttgctttaaatcactacatttttttgtaatttgttatgccgattataaaatttgagtaaaaatatattctcaacaaaatttagaaaatcaaatccatcgatatataaaacaggaattccaaaaatgcaaagttggtataacattcaaaaatccatcagttgttttccacattggtagaaaaaaaggaggtaaagtcataatcatctcaatacctgcaggaaaaaaacacttgacaaaatttaacacttccatgataaacactcttagcaaacctggaaaagaagagaactttctcaatcagataaagagcaaccataaaaagcctacagctaatatcctaatgaatagtgtaaggctgaatgctttccccaaagatgggaaacaagacaagaatgcctgagctcatcttttctgttcagcattgtacaggagttcccatacagtgcaataaggaaatcaaaaaagtaatagtcataaagattagaaaggaagaagtaaaactgtgtttattcagagacaacaaaattgtttacatagaaaatcctaaggaattgtattaactttatattgctgctgtgacaattttgacaaacttagaggatcggaacaacacaaatttattgccttccagttttgtaggttagaagtgtgacacaagtctcactgggctgagatcaagagcatcggcagggctgtgtttcaatctgttcccctgactactccagcttctagaaaccacccacattttccttcatttgttaccctctttcttgatttttaacaccagcaacattgtatctctctgatcattcttcacacacaagtattttttctcatctgtggcttgccttttagttttccactgttttgaaaaatagatctaaactttgattgggtaaatgtatcagatttttactttatggttagaaatttcctatgccctattaagaagctttgcctctattcataatagcaaagacatggaatcaaccaagatgcccataaatggtggcctggataaagaaaatgtggtacatgtacaccatggcatactacatagccatgaaaaagaatgagctcatgtcctttgcagctggagttggagctggaggccattatcctaagtgaattaatgccgaaacagaaaatcaaataccacttgttctcataagtgagagctaaacattgagtatacatggacacaaagaagggaaaaatagacactagggcctacttgaaggtggaagttgggagaagggtgaggactgaaaaactatctattgagtactatgttgattacctgggtgatagaattatctgtatatcaaaccccatgtaacatttacccatgtaacaaatctgcatatctaccctctgaacctaaaataaaagttggggaaaaaaaaataaggaaaagcagcagctttgcctaatccaaggttgcatagcttctggagattttatagacttatgatcactttcagatttatttcaaattaatgttttgtatggtgacagggatcaaggttggttatccaattgacccagatccatttatgaaaaataatatcttctttcattgaatttccttggcatctttattgcaaatcaattgattgtatatatatatataggcctatttgcaaactgtactctatttcctttatttatttgcctattctttaaccagtatacgtgtttaattactgaacttttataagttttgaaattaggtactatggctcctccccaactttgttgttctttctcagtctttttttcaaaattgtttcaggcatactagatcctttgtatttagaatcacctcctaatttctatagaaaagcctattgggatttcaattgaaattgaattgcatttataggtcaatttggaaataaatggcatgttagcaatatgaagtcttccaatccatgaactttgtatagctgtcatttacctaggccttctttatttttccccagaaatataatgtggttttcagtgtaacaatcttataaattttttgttagatttatttgatgctattataaatgaaatttttaaaaataccaccttgcaaatatttgtccaggggttggaaaactttttttaaaggccaaaaagtttatgggaagatcatgtgcataatgttatttaacaaatagattaaagttatatttgatttcccatctgccaacaaaatttggctaagcacctactatatgcaaagctgtagttacccaggaatacaaatttgatcacatataaatgctctagaggatttctgaagaaacgtgttataagtgcttaccgggaatgtccattttttccagcaaatttataactcagtggttctcaatcctcattgcacattagaaagacatgcagtgttttaagaaaacaccgatatccagaccctactcaaagccactcctaagcagaaatttgaaacttctctctaaaaaagttattccaaaatattattgtccttaacacatacatcttggagatggtgctgttatttttccttcttaaaaaaatatccagaccccttttaattatattactttcatccttatacatctagagctttacacgtagcatgcattatacacaacttcaaagaatgaacggaagattgcttgctaacaaaaacaaaaggaaaagagaaatctgctaatgcagcattccaaggcatctcctgagaatgtgttcattggactgagggcatttcactgagatgagctgggggcaccaaacgttccaagcaagactggatacctaatttgctgggttaagtacaaaatgaaaataagggtctcttgttcacaagttacaagaatttcaagacagtgttagcagagcatttaaccaagcatggaaccattctaggcataaggccctgtgcaaatgcactgattacttgtctactaagcccgcccttgttttgaggaccagagtgctccctatacatccgatagttctgcacacttgctgacaatcaggcatacaagggaaagcagttgattgcatttcgatcccaatgtcatgaatttgtgttgtttgttcatttaaaacattactttttaggcagggcacggtggctcacgcctgtaatcccagcactttgggaggctgacgtgggcagatcacttgaagtcaggagtttgagaccagcctggccaacacggtgaaaccctgtctctactaaaaatacaaaaaattagctgggcatggtggtgggcacctgtaatcccagctacttgaagctgaggcaggagaattgcttgaacccaggaagcagagattgcagtgagtcgagattgcaccactgcactccagcctgggcgacagagctagactctgtctcgaaaaaacaaacaacaaacaacaacaaaaaaactctacttcttaatttttgacttatcccctcttttgatgcctagagaaatcatttgaaattaaatcttcctgtcttcttgcccttgttttggataagcgcacatatttttagtgttgcaatttttcttttttgaccaatttccataaaacttgaaaatctaaaatgaggacctaaatctcagttcaatttttactgagagccagtcaataaatgtcattcctggagatttcagctcttgtcttaaagaccagcaacatctactgatcacccattcgatgctttgttttcgactcattctattcaggatgctataactagactaggtggcttataatagactagatggcttataaataacaggaatttgtttttcacagttctagaggctaggaggttcaagatcaaggcagattcagtatctagtgaagacctcctgtctggtcatagatggtaccttctagctgtgtcctcacataatggaaactataagctagctctgtggggtcccttttataaggcaaaatcccaattatgaaggctttaccttcatgatataattacctcccaaaggccccactgcctaatactatcaccttgaaggttaggatttcaacatataatttttggagggcatcaacattcagatcatagtttattaatttttctcctcataacaaaatgatgaaggaagaaatattttctctacttttcaaatgacaaagcaaagattcagaaagtttaaataacttgtccaagtaggaggtacagaacagtaatcaagattataaactcaaaatcaggcagatctagcttcaaatcttatatttgtacttatatgaatgagactttgaaaaaatactgaacttttatcaattacattttctataactgtacaatagaaaaaataacgtctgcctcataggattgtcatgtggactgagctaatataagcaaagtgcctagaaaaataagataaacaattaacagtggtaattatcattaacgtcacacatctagtaagtaacaatgctttaattatttctccttctctaaaaatagcattggtaaattttccactctcttgttttagataattcctggattaaagaaaaatagtaagcatcaactatcttccagttgagcttgaggctagaacaaaaaactattactgcaaatattgaagaaaatgcaaagtatagtgctcactagcattttgaaaatactatacctaactgttcaaaaccttggcttcttccctattcctgattattaggcttaaaataccaggaatatctttatctcatagaatagcatgaaaagttgttttgtgaatgcactgaaatgagttaacagcctttccaatactttctattcatccttgatacaatggtggacacctggcatatgtaactccttttataatttccttctcaatacatctcctgagcataactatacgattcctcccaatatatcctgtcttggcaaagtgccatgtatgtaatagacaggaggatatggtgtttgattatagtaggaaagggagaagggcttcacactagaatattttcaaggttcccaaaagcttaaaaaaaaaaaagaatctgattctgtaccataaacctgtagagaaaataggcaaacatgttatttaaaaaaaaagaagaagaagaaaaaagttttggtatctttttcattacaaaagcttgctcattataaaaattttgaatacagggaaatttaatgaaaacaaattcaagtttccaccgtcaaagccaactgcattttgatgacttttcttcagatgccatgttgctgctcagtttctgctgacatctttctgttccctttcttctttcctttgttacgtacctagtgccttcatgctaactttcatttattccctcacctacccacttctcatgtgttatggaccagtgtggaaatctggtgccctatgcactagacttttcataatcctctcactccataaaagtttaatgtgcccccagttccctctcttaggtctgtggccctctgcctaaactaatctggcaacacatctgcttatagtcagtaagtataatcaacagaggctttattactttcagaagagaaaacagagggtaagaatattgggtagcccaagggaagattcatttattgaagataagaccatcaaatgcataaaacaaacatatgctgaacacagctggaagtagcaccttgttatggtagaaagagcatggacaaacaatagatctagattcaaatccagatgctcactaacaggcaactaccttaacttctctgagcctcagtgaagtggtaaagccaactgcataatcttgccatgaggctttaatgaataacaagtacaaaatgcccagttcataagagttcctttaaaaagattagtacaaggtgctgtgagatttttttaaaatgaatcagatatgattatgtcctcatggaacttactatctaggagaataaataatacatacataaaagtaatcataatactcaatttttagaactcctattatgacctggatatatgtattcattttacagatgaggaaactaaggctcagagaaggaaagtgacttgactaaggtcacaaaagtaggaaattgcaaaactagaatttgaacctttatctgctcaactgcacgttgcattaatataacataggcacttatttttaaacctttaaaagtcttatagtcagtaaatacactcaacacaggtacagatttaaaacttcctatacatataagactataagacacctatacaaattttatagtacagggtcaggggaaggtgatgccagtactcccttagctgccccagctggtatctcagtaggtaatgtgtcccctcattccactgggcccaggtcagcactagggactcacctatgagttgcagtccttgtggcctagactatctctcaaagtttatttggggctccagagcactctagcccatggtggtgagggttgtggaaactcaagttctgactgtggaaattggcaattcccctctggctagggctggtttaaaagctccctccatgggtgtgtgtaagctgaatttggtttggttttcctttctgctctagcaggacagtgctgagttcaattactcacaattgctgtgctctccctctttccagcatacagaattgctctccacaccactctgcagctgccagaggatctgggaggggagggctggtgctggctagtcaagactgtttttcctgccacttcagggcattattcagtgatatgaagtcaaaaccaggcactgtgagtgctcacccgatttttggttcttacaaaggtgttttttttgtgtgtgtagatagttgtcaaattggtatccttgcaggagagatgatcggtggagttttctattctacaatcttactcttccccaaagtcctctgcctgcatttttaatttttgccaagctagtatgtgtgaaaacatatctttctttggtttcaatttgaaatatcttgagtagtttaagcatttatttacatatttatgaaaatgttcatagttcttctatgaaaacctgatcatgccttttactcatttttctactaggttattcactgacttactgacttttagattttttttttctagatattaaacttctgtcagttaattgcccttaagcttcctgcttccactagtttatccacggcaatcaatcagcaaggttaattttctgtggaaacatcaccatacatgcctacataatcatccataaattctttttagaattcagcacattaaattttaaaaatacatttgaatacaattgacacaattgaacatatttttctttcatccttaccccaaagttagggaaagtgccggaaatgagtgaggctttaaggatcaaaagttttcaacaaaatcttagaagaggaattttgctcatccaccactgatctttgtgttttcagtttgacagtacaattaaacacacatatattttatgttcatgcatatccttaattctcttaattataccagtcctgaattgtaggcaggaacagaatgtgtgtaggagagggggagaatgtagtgccagaggcagggaattttattggtgttgcctctgtctatagggtatatcatatttttaggaagaggagaaaaaatacattctgaactggtttcagttacttacataacagagggaatagccatgcctagaacagctttcatggatttgtcaattgacataaattaaaaccagatcaaacttcatttcatctctttttttctatagatttttcttgccttctcccccttttctttaccccaccctaacccctcttctcttcatgtctttaaaaatatttttgctttgtccacattttctgttgtatccagacacattttcccaatgctctggttccctttctgcctgagggaatgtttcctctctccttcattccttcattctaatcctctcaattatctaagcctctgcccagaatccccagcaaacattctgaaagagggagggggcttcatcttgctgattgattttaatatttttttgaaaccaggaaactttagtttaaccttttcttttatgaaaacatcatttttatattaaggcaattacttacatgttttagttattttaacaacaatggagagaattctttaacttcagaaaaacttctaagcacaaaagcttacccagctcaggaggtgcaaaaatggaaaaaataaaggatactgtcttcaataagacctgggtttaatccccagtttcatctctttccagggatgggacctctctgtgagtctgtttccttctctgtaaaacatttaatgtgcaggtatattgcagagattttcaatgagataacttgaggaaagacttaagtcattgttccagttagggttctaacttaagatcaaggacacttatgagaaggataagagacagacgggaaggttagggaacagtcatggcaagaagtgctaaccatagtgctctggagggcacggaagcagcaactagaccaatgtcaggcagtaggcatgaataaattactagcatttttagtcttgtggcagtttcttaactagaggagagacggtcactctattaacacccaattttttttcccaatcaaatagctgattttccaaagaaaatgaagaatttttttttaagggaaagtgggtgcaacacagcccaaaatcaaccaatgcctactacgtagtagcatttctactatgtaggaatgccaattccattccttaagccttttggttttgcttcatgttcctgggctttaaaatgaaatcgtgtaatttcagattgatttcagggggacccacatccccaggtccaagtcagctgcttaagtctttatggtgaaagaaagggtaggaaaggcagatggtttgtgtgttttagaaataaatacatactatagtccacctaatttttcttctcttctctgtccatcatttaatttttaggattctgaatggactggtgagggaagagatatcatcttcaaatgttgccagatgagagacacaggccctgagagaaacattaatctaatatttattgttggatcttatgtcttaaaagatgttaagattcaagtaaatagagactatatataattcctattactgttactgctaataataatgctaatagcatctaagtagactttgatctcaaaactagagtaattataattttaactattgggctgcattactctaatgtgttaaaaccatattaatcagaacaacattcaaaagggagcccagaattttcaaaggtctttttccccaggatctcagaatatatttgtagtgtgaagttaagattttttgcagaattaagaatccagaaacaaatcctacatttacagtcaactgattttcaacaaaggtgctaagaccgctcaatggggaaagaataatctcttcaataaatggtgcttggacaatcagacatttacatgcaaaagaatgaagtttgacccttacctcataccacatacaaatttaattcaaaaattaagtgaaaaagacataaaactctttgaagaatatataggggtatatcttcacgactttggatttagcaaaggactcgtacatatgatgccaagagcatgagcaacaaaattaaaaatatataaaatggacttcaaaagtaaaaacttctgtgcatcgatggatactataaagaaaatgaaagacaagtcacaggatggagaaaatattttcaaataatatctctcataagagcctaatatctagaatatataaagaactcataactcaacagcaaaaaaaaccaatcaacccacttttgaaatgggcaaaggacatgagtagacatttcttctgagagaaatggccatacaagtggtcagcaagctcatgaaaatatgctcagtatcattagttattagggaagtgcaaatcaaaactataaacgagatacttcacacccatgagaatggctataattttaaaaacacagaaaagtgagttggtgaagacaatatggagaaattagaatcctcaaacattgctggtggaaatgtaaaatggtgcagctgctgctgaaaactgtttgatacattaaacatagaattaccataggacccagcaattccaccagtaatttacacgaagaattaaaaacagaagttcaaacaaaaacttgtacacgaatattcacatagcactatttacaatagccaaaagatggaaacaacctaaatgaccaccagctgatgaacagataaacaaattatggtatatccacataattgaatattattcactcataaaaaggaatgaagcactgatacatgctacaacatggatgaaccttgaaaagatgctaagcaaaagaagccaggcaaaaaaagaccacaagttttgtgaattgatttacatgaaatatccaaaataggcaaatccatggagacagaaagtagattaatgactgccaaggattagagatggggaggagaataagagacactgcttgaagagtgaaaggcttcctttggtattcaggaaaatgttcaggaactatgtaaaggaaatgcttgcacagcattgggaatgtgctaaatgtaactaatggtaaattttatattatgtataatttactacacacacacacacacacacacacacacacacacacagaggttaagatttcctagaaggtagttttggcctgcaattctatttcttctgatctgaagctgctatttagagagtctttccctttgaatctaaaacttaatcctcaaccacacacctttgtcatctttatggcaacccagttctcctgtgtataattataagactagctaataattgtatgccaggaacattttatttcttaaatatgtacaaaactccaagtatgtggtgaccattgtcttagacactgaagataccacagagaataagccataaatatctactctcaagaaagttagctcattgaaaagagacaagaaataaatgaatgaaataggtaatttcacaagctctcggtgttatgaaaaaaataaaatagatggcacgatggaaaataatagggagagagggggatctagttcagcctgggtggtcaaggaaggcctctctgaggtgacatgtgagctgaaatcttgcattcagaaggatctcaggggaagagtcttccaggcaaaggaaaccacacaagcaagaacctaaggcaggaaaggctttgggttgtttaaaaaaggctagattagctgaagcagaattaggaagggtagagaatttgttgatttaatgggaaatgtaggaaataggaaatgggaaatgaatcagagcctgtaaggcctgtaagtttatgagggaagccattgcagagttttaggcaagggaaaacatgatctgattactatttgaaaaacagcaccactctggctgctaagtgaagaatgtgttgtaggatgcagagcaggagaccagttagaagactgttgtgttagattgcagatgcaaggcaatggtggccagagctgtgtgggaatggtgaaggtggaaaaaatcatccaagactccttaccctttcattgcccactcctgctttttggacatcacataggataccctgcccagacccagcctcagtaacctgtcccagcatgactttcctgcccttatctcctgcatgggggctggagggacagcattcacaaaccacaatgacgaaaataatgaagaacaatagcctgagatttcttctattttcaagaatgtgggctctgtaacaaatacccagatccagaaacttcctgtttataaaagggggtccagcagttcaaagcagggcttgcttttcaaagaagcaatacgcgccctgtgcacacaaggagagcaaagactcttagccctgtgggaggagatctccaaaggccacaatatcatctcccctcacagtagattattaatcccattgtcaatgtaagcccagacagggcgcccagattccaggcccgtctgtgtttcccactgttcatgcttgaggactagcatgatgactggacaagaggcagatgaagtggacacagaatccaaagtagacaaataatttgaatgcagggataagcacacctgtcaagatataccttggaaaacaaaactccttcacacttcagattcctcaggaaaggcccaaggtcttaaaggaagatgccccacacagatttcctgtttaaaggaaaatatagctttgttgtagcaaaagtcaaaggcctaagaagtaagattcaggagctttcctgtgatgagggaaagctgtgagccataggaggcttttgattattcttattcctgtgggttaataaattggaaaagaagaaaagctgaaagctggagagctgctatagacgactgcaaaaggttcagggatgtgctgggcatatcaaagacaagggtccctctaaattttcttaatttataagcagatgacaaggcagcatatgcaggccattgagcaaaagcagcaataatttaaaaggaatgaacacacaggtttagtgtcataagagaataaaatttatggccaggttaatctgatgtatgtagctaatggggtgcataattgtgactgtgctttgggaataatttggcataaatggtaaacagtttatgtaattaagtgtaattgttgtgctacataactgaacacattttagctttttcttttctcacttcaagttttctagtatccatactattaatactgtaaatgtggctatttttttctgatagtaacactgaattagcgtcctcatgaggcaaacccaaaccagttagcagttgaactttcacagtctgtcccttctacctactcctgtctttagatctccctgtcttccaaggagggtcctccttggttagaacagttatttgggcttcaccgcgcagaagcagaaaggggaaaagaaaaatcagcacacccattggaaccgagaattagagaaaagtttgctgcaagagttgctgatgtgctatgtgaaagagttagatgatagagacaagaggaattcttttaaatgtgttactgtgatccactattgcatcaagaaatgcaagtaaaacctttaggttattttgaactttctgtggattgctggatttttgctttttgagtttttggggttttttggggccatgatacagttcggagactagactacatgggtcacattataagtgttttaaccattatctcaaacactgataaaaatatcttttaaagacctcaaatctcactccccaatggcgtggattccactttcactaattctcatgctatgtctcaggaccctggactacccaattccactctgccagtatgtctgtcaatttttcacacctgtgcaaagtttcatacacagaaaggattatttaaagctatttggttaatcataactgctaaaattataaatgctaaaacttaggttttcttatgtttttaggttcaatttataaattttgttattctgtttttaaaaatctcaaaaaatatagcttttacttttagtttgtagtatgtttaactacaaatgtagcaggttagatcttactaagtggtataatctatttaaaaattaaattaattaaaatatcagaaacattttgtgatggtgttttgatttgtcaatgtggctaggctgcagtcccccagttaatgaaccaaatttcaatctcaatgcagctatgaagagatttgaatccttattctgttcactttaactaagggagagattattctgggtgagcctgacttaatcagttggaaagcctaaaaagtagggcagaggattttcccttctaatggcctgccttacagacctcagacttgcttagcccttgctttccaaaagccaattccttgtaataaatcatacatgcatgcatgcacatgtatgtatacacacacacacacacatctcctactggatctgcttctcagattaagctcttgaatgatacacatttacacatttcaaatttggtataactgattctttcacaaacataaaatatctcacagggcaaacttacaaacaatataagcaaaatttttataaatctaataggatacattttaaactttaaaaaatcagtttttcttaaatatgcaacactgcttataaaactatattctcactttcaaattaaacacaaataataattaagcatcgcaaattacaatcacaaagctaatatgcagtttctctaaattgtcaatttttctcgatatttcaaatgtctaaaataacaaacaagaaagattaagataattattctaatctatcttctgaaaacacaaaagtttcatttacttcattatttctctatttattggtatacattgccaaagttactcaacatcacttacccaactcttaaaagccataaaactgaatttgaatcagggtaagtggtttaattcaggaaaataaaacaaacaactgaacagtaagctcagcctgcctaagatatagtgaagagattttatttcacaagtgggtcagaaaaagttttaaaagacaaatacctatgagaagtatctgaatatgaattcagtttaacttaataaggtaaattctatttgaatctttcctgttttgacagaggggaaacttccaaatagctggaggtggctgagttgaaaagaaggaggtgttagtgaaagaaaacaggagcagaccatggaggacaaagtttagggaactaacccaacgatgtacacatagattcacagcttcatgaaaactatgatatcgatgagagctgaagctgtggatatggagagccagaaagatactcaagaaagcttcctatagaaaaattggcaaagcttggtgaggccacctgaaaggtctaccatgatttgagaagcaatgcttcaggtggatgaactgattctgaatactgcctattacaaagatagatatatatcgaagaagaaatacatataacaaagttaaggatttttgttgttgtcatttgttttaaacttctcaaggagggtttcccttaaaaaacaaaaacaacaataacaaaagaaatctacttccaatgagaagggaggaaaggagacctggagtcacagaggccagggcaactggagtctgaaggcctcacagcaacttccagcagagttgaggccattgggagtccaagaaaggaaaccgaaagagccttcaggttaaagagtctagtacaattttgcatagttttagaatagggatttagagattggtaggaatgagagcaactgaagatgtaagaaaattggaggcaagagaaagaggaaaattttgaaaagtgttattagagtcccattagttttctttgaaaaattctaataaaggctggaactatattttaattacttttgcttgctggactgtgtgtctaactgcacctgggccactaaacagtctagaatttattcagatcacatatattcaagtgactcactaaattctgctatgcagaaatggaaaggtatactttttgttgcttgccaaagtacagatatcaacttcttctccagaaaagcaaatctgctttccaaaaagtcatcttttttcttatattcagggacaaacaaaatctgtctgccttttgtaggtttatgtatttctcaggcaccacattatgtgagtttcaaagaaaatgtatagtgctggtggcagggtacatttattcaataatttattaagcagacatctttttagaagcctccatgtgcccagcattgtgctgggttctgagatcaagggataagactcaaatccttcaagaaatttgcagcctggtggagaagactgaattgattctcccaatccttttggaaactgatttagcaacaattattttaaaatcagacaaatttaaattctaacccaataaatctattccaagaaattcgacctgacaaaatcatttttattttttaaatttaatttttaattacaatttaaaattttaatttttaattacaatttaaaattttaatttttaattacaatttaaaattttaatttttaattacaatttaaaattttcatttttaattacctcagtaattaaaagccagatgtcagttccaatcctgtttctgccacttattagactattacttagcttatcgtggggtaagtaattgcagagagcacttagctatctgcaatatgaagataacgattctagcacacgaggtcattgtaagtattaactgcgataacatacgtagagtttatcactgtgcctgagtcgtggaagatgcttaataaacaatcatgtctccccttaagtgataaccacagaggggttacaactacacagaaatctataaacatgtgaatgaggctgaaaaattatgtgctcgaactagttttgcttatttttttttaattttaatttctgagaatgcatttctgtggctgaaacttcaagctccaggctccaaaatatattcatatatttcgtggagttggagaatgtgtttttccttttccaaagacaagacacattttgaaacataataaagaaagagcaaggctttttcttgatttccactcaaaattggtgttggacattcagcagcacgacttagccactcatttattagccactcaacaaacatttactgaagatctactatgtgccagatactaggctggtggctgggcattgggagtgaaatgacaacccctctttgcatttgaggggtctatttctggtatttactgacaaatctattattatagaacaagtaaaccccacgacagaagcctggaagagaggcaactcaataacgctggttagttacagagtgcttcctggagaacatagtgcttaaattgagttttaaaggaggagaagcagtagctagataaagctagaaaacatatctcattcagtattgatgataactaagtttaaaagttggggaacagagtgaatagtcaagttttcagcctatctgccaaaatgagtactaagaggattcaagaaagagggaaactgagacaaaggagctgagaaggaacatgcccagaagaaagaaaagtatatgcaaaggcaaataaacaggataagtgaccaagggcaacccaaaaaaatcattccacacttaacacttagattgtactctctggaattgttcttcagattaatttaaaccatttttcacatttaccaatttttctcacaagaaaggaagccttaatgctgaaattgccccaacatatttaccactttgccccccatactgagtgaaagatagccaagggaatcataaagtttgcaacaaattgaccacaaattattttttcaagaaacaggtctcacttaggattaatgataactgatcacagcttctaaggaatacataacaatagcaatgattcagaaaagtagtgaaacagagcatcccctaaaacacttattttctcagctgtcttactttggcagaagatggacttcctcagagtgaccaacagcacagtaattttacccaaaatgtgtctaaacacattttctcttaataccacctttttaaccttctcacaaggactttacgccgcattaaaagcaagaagtggagatgggcaaattgagtatgactagcaaaaagggtgtgtttacgctaattaagagagataatgctctctgatgtatcaacattatattaaatggaggcacatctcacacaaggttggcatctgaagtttggatgtgaggcacatagtaagtatggtcgaaagtactgttgaacatcccataagccacccacaaagagtaacacacatgttttgtgttgaaaaccctgttcattgatgtgtgtgtaaatgaataatgcatacagtaataaaagtctataataagaggcacctatgcaaatgaaatttaaggcattttcatggtatttaaaagatcacttgcatagttgaatttaaaaactttaatatatgatgtgtctccactgctcaatacttaatgccagtggaggagtctaggatttttacaggtctaaggaatatactctggcagagagagcactgaagttgaaattggaagagctgggtttaagctctgctactgtgacttattgaaaaagagggcttacatctcatgtcacatcaaatctttatagtttttgtccaaaatgttaagatagtcttggaaatacttgtgtctgtattttggcatgtgatatgttgacactgtgaactagatatgaaagtaaaagagccctaggccactgggccaggaactcatggcttctattcctttctatgcttaataataaaaatcaatccaggacctttttatttaccttgggtatctttactagttctcttactacaccgctcaataaatgtttaggctatttttagagctacaaacagtaacaatatttttaaacagagtcaaggaggtttcccccaatagcctcacatgttgaatgaaaaacagccacaggaatcataatgtttgcaataaattgaccacagattatttttcagaaaacatatctcactcaatattgatgataactaagtttaaaagttagagaacagagtgaatagtcaagttttcagcctatctgccaaaatgagtactaagacgatccaagaaagagggaaactgagacaaagaagctgagaaggaacattattccattgtccacagccctgagagttaaggaagttatacatgtggtcattgcccaggtccactatctttggaacctatcagaacttagaaaaccaaggtaacttttttttaatcctaacctctatacactctaatggagacagccctttggatatgaatagctaaatttgatttctcaaagatggctggtaaaactaggcttcatttaggatttcccaggtatctagggactattttccaaataatgcaggctcaataaaactgccaaatgtgctttgtcatttgatttttttcagatatgagtaatttaatccatatgttgctcattcataaaaatctctacaatgcagtttaagatttttaagagccatttgttttcccaggaggtcctggagcttacttattacttttctagaaactagtttttaaatcaaatttcaatacaggtgactgactctcttttccttatgaaatctggatcctgaaattttaggttaggtttgaaaacagattccaaaatgttttgcctattattttatttgcagactatttgttctgaggtcaatttttgtgggcatttacctcagctttgtacggaacttaaaatcttaggagtaagcgattcctcctctatcccaggatctcatggaaagattctaaatctccttgctcatgtaggagctgtattttctcagggaactaaggtttcatttataaaatacctttttcagggttcttattattctatttcgctagaaggttaactcacctcatgcagacaggaggtgacatgtctgtgtcggaaagaagaatcctccccagtagatgaggctcaagttccaacctcaagaagtcatttcgctcccaggcgaaggcctcattgatgatgccaattcaaagtctctgcctttctattttccttatttcaacttcatcttcaaaaagataaaatctgcctcaaaaacagcttagaaatctgttctcacccccactcctccccgcctcatggtcaccctccactttctttggtctgaaaccaattgtgtaaattaattcacttctacattgctaattgctacggaagctgagaactcagaggctgcaaatacatctttttgggtttttttgccattttgaaagtacagctagtcttttaactgccttggggaaacaactctactacccaaatggaaaaggcctctgagaactgtctattatgtagtgattaaatgcagggcctctggaggccgactgcctgtattaaaatcccagggctaccccttactccctgtgagtcctcaggcaagtcgctttagtccctctgtgcctcagtttccgcacccataaaatggggatggcagcaatatatacctaaaaagactattgtgagcaatgaatgaaattaagagttagaacaaggcctagcatagtgtaaagcattcaaaaaatggcagctttaccgggctctctcccctttgactagctccctcctgggccagcacacactgtacagagaattccaaagcacttgattcaagatatagacactttatgtgtgcctttgcctgtcatctattcatttattccacaaatatctatgaagctatgtgcaagatgctgtgctgtgtgctggggtattattttgttcccataaaaatatagacccaagactcacttttatcaaatgataacaaaggaaacaatacaggaaccaatgctctcctctgcccctatctgcctcctgtctgaatccacacactaagactggagaaacaaatttgtcccaaagggttctcacacaccagagaaccattaaattaaaaagcactgatgcttctgggaggaaaagactgaaggctgtcagcactttgcattaacagcttctatccagcaggcccaggcccctgacccagctaaggagccccttttgcatggaaacagcccgtgctgctgaatgagactatgcggtgcgttcccttccaggtgcccggggactgatgcgtgctgctcattagtggtaaatggtagctacatgtggaaatcccagcacattgaaaagagaatacaaccctaaggaaccataaatcacttgcattgattctaaaactgactgagatgcggcgagagagttgtttgtttagaatttaatttgattcgtcagccattggacaggcctttatttgctgttaaactgctacatttccagctactgaagctgactcaggtgttcccgagtttttgtcttttgtgggggagggaggcagatctgtacacagagagagtggaatgcatttttgttcaaaacctgcttctgccagcgttgaaagcactcaagtgaaaggtaaatcacactgatcaagtgacatggtagatttgggtgcctgctgcagttggtgtgccatagctgggcacagctgcaagttggttgtgtttggcatcttctgatggtaaactttctattcccttgtgaagactcaggcagactggaaagcatagaccattgtatttacagctattggatgcagttcttaagcaggcaaaaaagaaaaataagacccccttatttctggctctcagttcatcagctatctgaaaccctgacctcagaatttctcacctcctgttctgcaccccctgaatttcccttccatattagctgctcactgtactaaacttggcctgagccatcccatgataatggtccatctccaggctcttgatgttatccacccacaaccccccacttctctcaaaaggatcctggtttggacaatacattatgattattgtatttatactgtgtgagtctgctgctaacttgcaaatatgtctccattgccttagaaacgaaagtcctgcctttccaaaattgaaaattccaaactctttcctctaccgctcacctgctttccctcacctccaattcaaccaccactcaaatcaatctccttgtctcgcctcctgaaaaactgaggctactaaccatgagctcctttatcatctctcctctcctcctcagaagatttctgtatcatcacttatattttatggctttgggagcagcaaaaccagggttcaaatgcctgatccgcccaccatgtagtggctgtgtaagcttgggcaagtttccatgtctacaaattgaaaaccaccatttctatgccacaggacagctggtataattaagaatgaatacagcacttgatgaggctcacctggtaagagatagaggcaagacagctgtctttcctctatctcttccatgtctcagcagcttccccggcctacgctcgctgtcttatttctctctactctgtgtagggacttgatcctgcagttagccccccttactccaagaccatttgtggtcgtctcattgttgtggttttacccttaaaatctatcaagcctctaattctcctatcccgaataatccctcttgagctacaactctcttggcttggtctcatatttcacttctgaaatgactgtgaagagtcttctgctaccagctgacggtatgtcacagcctaacatctccttaattaactgtcatctggctgatattctgatcattctataatacttgagaaagccctgcctcatgatctagtatatcaccaccacacaccctttctaagacatctctttgatacttgaatcatgatgctgccctttctagaaacgacgctactgcagggtagcgtccttatgctcactcaagcccttccatcaccccaacctctctttctgcacctaatacgctataaagataagattaaaataatttaaaaaggcgggccacggtggctcacgcctgtaatcccagcatttgagaggccaaggcaggtgaatcacttgagctcaggagttcaagaccagcctcgccaacatggcaaaaccccatctctactcaaaacacgaaaattagctcagtgtagtggcaggtgcgtataatcccagctaactgggaggctgaggcaggagaactattggaacctgggaggcagaggttgcagtgggccaaaattacaccactgcactccagcctggatgacagaatgagactctactgaaataataataattattattatttaaagagttcgatgatgaaataggtgtagaagactttgcttactatttccctttttagagattcttactgtatgttaacagattaaaggctcttcgaagagttctgcaggaaagaatacttacctgctcaataattaccgattgattagtaacacccatgaagtacttacttttattaatatttgactttttattgtacaaatgtctcttcaagttgttcctaagctactagcaaataaaatttgtgttacgtattttttatttgcctcccaaagcctgttttcagacatggacatagtattaatatatatccattataaaccagactgcaaggtcacttaaatatttttgttttttaaaaaattaatttacactacgtttgtctgaaatgaacaggaaagcaatgaacgataaagtttctacgacacaactattttctttggctctctcaaatgcctcatttctccatgtcttttttaatttttatttttattttgtttttatttttttgacatggagtctcactctgcagcctgggatgaagtgcagtggcacaatctcagctcactgcagcctccacccctgggttcaagagattctcctgcctcagcctcccaaggagctgggatgacaggcacctgccaccacgcccagctaatttttgtattttttgtagagacggggtttcaccgtgttggtcaggctggtctcgaactcctgacctcaagttatccacccaccttggcttcccaaagtgctgggattacaggcatgaaccaccgtgcccggcctttccatgtcttatacgacctgaagaaggaaggaggtcatctgctggagccaggggccatgctcgctccattcaatgcatgatcacatgtaagctttctgtgaaacagatatgactatacacatttttaccaattataaactgaggctcagagtcacccaccaatgaagtgacagagtctgcattcaaatgtaggtctgctgattctaaaaatctgtgatttttgcacaaaatggcagcctttaccaatagtgaggtgagtggaagtgacatgcaaatgcagcaggtgggaaaagagagtgcccaagaagagaaaactatttgtccagtggctggaatgatgagcctttgccaagagcattgtgaggcagagaaattatagctaccagctgccaactcccaatcttgggccatagagaaaagaggagaaaaagatacagaagaaaaggaaaactgaacaaagaaacaaaaagtaatatgctcaaattgcctcagctgctgcaaagctatttgccctagggaaaaaaatagactgtttttcctgccttgacttagtgctgatcacctggtatcatgaaaattcgaccagactatgccaggcagtttgtctactgcaaaagatgatgagagaaaaaactataagcttccattggagccacagactgtgttttatacttttctcccatgtctgtttctgcttcctaacaattaaatacatgagtgtttattgaatgccatttgaatgaatgaatgaaaataggtttatgtcagagagctatttaaattccctaccactccttaattagttactgcagccacaaaacctttgagaaacaaggcaggtatacatttataagtaaaattatttccaaattggtattctgaaaagaagaaatatattaacattgcttgtgggtggtttagtacatccatcatcaaaatgtcaatatttatacacatatgactctaatattttgatggtgcgttatcataacatctagaattcactcaacactgccgtgccttcctgacctctacagcaaatcaaactgtatcttgttgatctatgttgagtgcaagctccactgatggaaataatctcttcctctacaagacaggggtaaggtttcctatatgttacatggtaagtaaaaatccagtacaacgggaagcaaatggcttggtggccactcttcactagacaataggaagataaggacagaaataaaagaagaaaccctttgttcttggtgcttttcacagaggattcttggaccctctatgaaaacccaactctctgaggctttttctgtgaaatcactggcagataggaacttttcagctagcacatgtcaaagcttctgccaggaatgtaaactgtacaataatttttttatgtctttagacacctaaaacagaaaccttaaacacccaagtgtcaaaataagacagataacccaataaatttgctagagcagggacagggaaaacaaacacagccttctgttatacggatgtctgttagctcgctccgaccactagcctgaaaccttagcctgccacacgtctttcctgtcgggctgtttatttagactcccgtaaagcctctcggcacccatttttaattttcagcttgcttcttgtcagctttctgaaaagcatagcaagatccactgtttaacaaaaacacacacaaatcagaggaggaggagatggatggcagagggtagtgggtgcaggcatcccccagtgcactgtggggggaccacattcctggtcccatttgtttgtaacagagggcaagggttgtcaatcggggtcattcaatcttgcatgcttggatttaactatacggctgtcctcataagaaaggtttgcctcgttcggtgctatattctgcattcattcataaaacactctgtaaatgctctttggaaatgttagtttaaaaaaaaaagaaaacttcagtggtgctagttcatttcattctgatagttttctattcttgattagatggcttgaagaggcctcaagcaataatcctgtccttccaaagaaggataatagacttttgagtttaaagatgatcatcagatatgttattttccttaaacgcacctgataatccaccgagcagcaactacttatcaagtaattgttacaggcaaagtgctgtagttagacctgagtagagaaaacgtattttgtgaaccaaaaattggaattcaggatttcatatggaataactgtggcaaattccaactcaagaggcagtcagggagctgcagtataggtgcccccaatactggaatttataggcattttgataacttcagcaggggcaatattaaagactatttaaaagtgggctcgttgctctatgaaagcaagccttatggtctgcaaaagtaagggttatagtgggggatataacatgggggatataacattttttcatctcttcactgtctctccacttttacccccatgcatttggaagcaatctctcagtttcctagaagcccataggatcaatttatatttttttagtagtcatcgatctcaacagtgaatagtaatttattctcgattatagtgattttcctaagaatgtaagattttcaggaactggtgggcaaagaaagaaaagaaaggagttcttttttttaaaaaaaagtaaattgctcctatgattccatcacatgtatgtgtgtgtgtgtgtgtgtgcacgtgtgcaattacacatatatacaggaagaggcaaaagtcccaggtcacatccaacatatacaatcctaccccttcctcagggataaccactgttaacatataaaagcactattttcctggatttattctgtgcttaaatttgatatacaagcacatatatgtatatgtgtatatgcatatatgtatatgtcatatacaaatagccatacatacatgtatttctttttcacaaagatgggattctgctatatatatagatataaaatttgtttttataatataatttggttttatattaacattttattttgtatatcttgtcaagtcagtacatatttttctatgcagtcttgctaatggttgcatagtatggcattaaataattataatatcttttatttacccaatcccccaactgatgaacacatagctcattgccaatctggggtattaaaaaaggctgcaattaacattcttgtgaatatattttttcactgatttgtgttactatttctaaaatgtagagtcccagaaatagtgatccagagaactgggacttgcctgagttattaatatatcaaaagaaagaatgtaaggtggaggggcaagggatcatcagcatcagaagcagagagagtctggaaggcaaatgttggtaggttctgtctgagtcgtgttgagagaaaaggaagtctgagtctctgacatcaggtgtcttagttccactggcaaagtatctctctgaggggagcaagtgccacatgctctcttaggtgagaattttaattttaggtgataattagataatttattattgcctaattcctgtaacttattctgatcctgattctatgctcactaggcaaaattatgaatacaatatggtttccccaaagatctaacttgagaaagctgagtataggggaacatgcaggcagtaaactctctgccagtctgtgtactgggtttctgtaaatcctccctgagatatggatcctctcagtatagtggtaaaattggtttttaaacctacaggatagccaccctgtggggcctgctgaaagacaccctgtcatcaatatgatcaacacctcacctccattctgtattttcaattccaaatgcaggtaacccgtaagctcctagaaggcaagagatacccttgatctgagtttgtcatccccacagctgggggacagtggcagagtgggcatccattgccaagtcaatttctcaatgttcttctcttcacaattctcacctccactcccactgcgactccactagtcaggctcttatgtacaacatcagtactgccctcagctgactccactgtctccactcttgctctccttgatagcatgtgatgatagtgtcctattatttaaagaataacgtacaaccccctatgagctggccctaagaccagctttccaagtttcaaggataaattcttgtcaaaaagttgtcctggtttactgtttaccttgctgttaaagaacagagaaatgcctgatcacgaactcaccacaaatgaagtattgacttgggtttggatacctttcctggcattcagtattgcctggagaaaggttataaaaagatccagggcagctctctcctttgagtcggaggcccagtcctctgagatttgagattgcctcacctccaaagttaggatccccaggtctgctaaacatgtaaaaaaggtaaaaatttcacaggggaaggaaaaccatgtggtaatgtgtgaatattgtataataccattttgagacaaaaataaatgggcaacataattatgccttgattggtttttcatgtcaagtcttgatgtctgaaaatttgtttcatatcttattttaaaagaaataaaaattgggccaaagctagagaaaagagctattcctgagtttggcaagtgcccaatgtagatatgccgtaaattcttgatcaaacagaccccaactcataggcttcaacccttaacctgactttttttcagtattccactttcagaagatatgtttattacaagaaaagaagatcacattgaggcttcccttctgaaataaactcacaaatttcagaggatggcccgtggtcagtatcaactctacctgtcttggggagacagcatcacaaaggggtgcaactaacctggggcaaagaaaactagacctaatctcttccaaggcttgacttcctcatccaagtcagttagtctttttgagtttcagttttcttattcatgaaatgtcgataataacacttgccttctcagtctcagaggaggactgggaaaattaaatgaggtaatgtataggagaatgctttacctccacaatgcattattgtcattgacatattatcactttctataatcagtctaaagaatctcctgtgttctagagtcagatgggtactatatgggcaagacaactgtatatcctagcttttcctgggtgacctggatttcaaaagttctgcctgactgtccggataagtatactcttcaaagtgtgcatttttacatcgatttgaaaggggaaagggtagccacttaatttttaatgagatatgtaaatatatatcatataattggaaatctacacacaatattttaataataatcacctccctatgaatgacatagaatggtcaatgattaaaaagtcttgtataaaataaaactaagtgaaaaaagaaagaggatgcaacaagaaaggaaagctatcagaggtgtctgtttccaagtaggtaaaacttaccctttgaaattagataaaacgcttctgtacctttgactatgggcatgaagtcaaaggaggcattcctgcaatcagagctggatgtgagttatgactactttaaaagaagatgcctttcaagggaagtctttggcagctgtgtagctggattagaaaggagttaatttaagtgcgcaaataaatggaatctatatacatggggattagcgaatgtcattcttgacatttcaaaagaatggattttgacctcagttggaatatgcatgtgatgtgtctctcattccatccctagcattactaactggtgtattattatttcaacactaaacaaagagaaatagcacttgtccctggaccaacatgttactttagaagtcccagtctcaacacaaggaatattttgacagtggatggagcacataccccttgaaaaccccacatggcacagctggtaagtcacccagaaagccaattctatttaaatgcttatgaaacgtctaaggagaaattcaaaacattttttaaaaatcacagttgtaagtgaaatacttccagcagcaataagctgggaaagtagatggcaaaactcggggggttttcttcaacatggagagccaatctttccttcctttttaatgtatgtatgaatggatgtattttaacaggaggcaatgagggcttatatttgtatccaggttgattatgaaacactgagcagatttgtataacaaatcctcaaggaggtgaaaagtcctggtgagaaactcatctagtccagcttccaactgcaatatccaactcaggcaaactcctggtaactctaatgactttcctctctaatctcagtccagtttggccgttgggattcagttctcatcactcttccatctatggctcaggcacaaccactgtaataatgcacaccaacaatgaggagactttttgtttttgttttgaatatattaacctgaatttgataaagttagcaaatagtaacttccatagggatgattttttttcaggcagccatattgaaatgatcctaattttccttagggtcatgtctaagatcagagattggcaaactttttctgtaatgggctcgatgataaatatttaactctgtatacagactataaagtttccattgtggctgctcaattttgctactacatcatgcaatcagttacaggtaatatataaacaagttaaaatggctgtgttctaataaaatattttatggacatatatttgaattttatataattttcatgtgtcaacaatattacttttcttttgactttttccaactatttaaaaatgtaaaaaacactcttagctagcagaccatacaaaaacaggcagcaggccacatttggcccacgggctagtttgctgacccatgtctgagaaactcagtaggaaaaaattgccaagggacacttttaggagtcactacagaggaggttagctacggatacagccccttcctcaaaggttaaaggccagtcacgggtgatagtcattagtgctgtccactgaatattctctgttctttccctaggaacatggtagcattgtcacttcccacacccttatagtcactgtggcatgtgactataggagatgtgaatagaaacgacatgtattccttccaggtgaaaaattaaagagtaaagacatgatttatcatattcccttctctaggttacagtacttatgaatgggtgaagtacccgcaactgacctgcaggtcatatagcttgaacaagaaataagattctgttgtgttaaaccactgaaattttggggtgatttgttcacaggttagcccagcctgtactaaatgcaactggattattacagactatgatcagaggatgcctgtggttccttaaaatgaaatatttattcttatatcagcaagagacagccacttggccaactgaaaataggttaccacatacatcatggatttattgttcttcaatctgtgacctatcaagaaaactatatatagtagataatttgtaatgctactattcaatgcattaaatgcattgaataggttataagacaggtagtctcatattctgctgatggaaaagtaaactgctggaatctttctagaaagctaatttcctatgcccaccaaggtcttttataatttttcaaactcttggactacaaactctatttctaggaatctagcctaaaaatatagtcaagaatccaggcaaatatttgtgaataatgatattcattcttgtcaaaataacaaaaaatccctggaaataattgtattcagctttatgagaaatagtaaaaattatggcatattcatataatgaaaaagttatacaactatttaaaattaagtttataaagaaatttaataacgaaaaataaatatagtatgatttttacctatatttacatgtaatatatagagaaagagacaaagagaagaactggaataaaacacactgaaacataaacaaatggttattttattccattgacatttttatattttccaaattttctacagggaatatgtattactcttacaatcaaataaagcaataaaagtcatcccaaaccagccagctttagacttatctcctcagagcaccccaagtctgtttctgctttccataagctatgaaatgctcaagaatcctctgtagcgaagaaactccccactttctaacatttttacttagaacccctaattaagttatcagcataaaaccaccccaagaaaatgattcatagaagtccacatcagaaagaatgggccttcccctcttcccaatgttggcatatatcaattcaaagcttattactatttaaattactttattatcataattcctgtgaatgacttgctttggtaggattttatagatcttttaacctaccctttcagccttaccatccccactataatgccgacttccataacaacagcaaataatctcagtggcttaacacaatcaatcttgttcctttcacagtctgttcaggtatttagtgcatggccttctgttccatggttacagtatcttggcttttcttttatgggaccaccatctgtaagtgcttcctcagagggctttgctagatcctctgcattcagctagccaaacaagccaggcaagaaagttaggagaaaaggcatgcatcactctaccttcattccatttgccagaaaacagtcacatgaccccacttaaccacaagtgggactgaggaacgtggtctttctctatgttcataaatgggaggcaagggtggggaatgtcaccagtctctgccttacccactatagataactaagagtagctctcagctctcaatactacatattctggttcactttcatcttttgctaaaggaactctcccactcagttaatctttcccctactagatcccccaaattggttttgaatctcacctccaataagttgttttaaatgccccaatcaaaagaactcattcctttctttatggacctgttgcatgaatttctattataactgttctcggagtctggggcttatattagtgaaaattgtatgtttttccttcatcaaaggtaagcgactgaaccaggtgttattcttcaccatctcccatggtatccagccttgggttttcacatgctaagcactcagcaaatattaattcccttccattgcttttccatcaacatttgtgaaagctaacagaacaaaaatacaccagcctagtgtttcacataaatgctgccggttttagctctccctcttaacaaatattatatgaagagggagatttatatttataagaaggtccagaagaatcatccaagaagcacatgagctttaaaacctctttggggattgatttaagaaccaaaggatctagcataaggtttcgtattcctctgataatcccacgtattttgcagactttaaaactctctgtggacttttccttttcctggaaaatccaagttctttagtaaatcaacttttcagcccagtgggtataaaaacagactgtgtagtaaatgtgctttagctttgctgagtttgcaggcaaatggaaagaaaagcaaagaaataaagtaaaagtgagaggtgtgaactttccccatccatcttaatggagtgctaaccttcttgcctcaaggtgactgtttgaattctagaactattaaacaacaagctgaaatccaaacaatcagtctgggagtgaaattgccttgaaaaaggacagctgtgtccagttttgactaggatgcaggcttaagaaagcaagtacaccccaaataaactgattttggctgtcctctgtcagctttagactctgtaacctctcctccttcctcttccctgaaatgttcactccttttgaaagctggattgggtgtaaaatggggccttgcttttagggatggcatctgagaatgggcacattaagtgaaaggcactatcttttgtcaaagagtgcctcaaaactcttagaatttggagcgttagtgattgttgattttcaccatttggagtaatttgtacggtgcctagtactaggggttgtacagaggggaaaggcagaaagaggctagagaccgacaaacagagcttaagttaaaacatttaaaagcaacacatgcttatacagaaaatttagaaacctcagacaaaaagaaataaacaaaaattacccaagtccctatattccaaaacaaagctgttaacattttgatgttttgctctgtaacaatttttctctgcaaagggttcagaaggaatttttgttctttggtttgaagctattgaccagaccagaactgagactgtaggagaaactgaatctaaaaagagcaaactctaggcctaatttccaaagcatccttcttgatactatcttcatttataaaataaaaggactggaaccaaacaactccctgctgggtctgatgtttggtaattgggtaaaagcataagagaaaaaagaacacctgctttgaagtcaagtcagacatgaacttcatttccagctttaggacttaccacgtgtttcatctcaggcaaattctttaatttctctgacctaggtacctcatctttaaaatacaaataataatatgacttcataattacagtattttgaaaatgaagggacatcatcttgaagataataaacaatcaaaattgtaattattgttctatgattactatgggctcaggaggagttttagggaagctttcctaatataacacttcttcagtttctcctatagtctcagttctgtctggtcaatagcttcaaacaaacgaacacaaattcctactgaaacctatgcagaaaaaaagtattgcagggcaaaacaccaaaatgttaactgcattgttttggaatatagggacttgagtaatttttgtttatttctgtctgcagtttctaaattttctatataagcatgtgttgcttttaaatgttttaataaatatttttgctggaaaaaagagtaaatattcaacagatactgtgtgatgagtaggctaattattaagcagctctttgcagattgctgttgcataaattgtgcaactgtataccccagatttcttgggaaagttctaaatatggatattttgttccattggtttaacttagtctagtgtatatggttactctatactgttactccagttgtttgatttagtctgatgtatatgattactctataaatgagatacaatagcaaattagggaaaacatacatgattccacctatctagaaacttccatcatgaaaaagacctgtgtgtatactaaaataataataaaatcaaactatttgatgcctgagcagaaagcaagcacaaattgtaaggtgacaaatggggaagtcacactgggtactgacagcctggtgtgtttagacagagaactcttctggattcaatggagcacttcatgttgattggtgggacagatgaaaaaggaggagagaatctggggaaggttaaaatgcaaactagaaatggctaaacggttttcactagatgcgaaagaaatgcagcggagatgggattttaacagggttttggaattacaataattataaagaaatccatgggtcttaggcttccaaaaaggaaacgtgtgactctataggtatcagtcaggtaacattacgtaaggtgtagttataaccatgtcagattctttgccaactcagtgttttctaaggttaaaaaaaaaaaaaaattggatacccacttaataaaatgtattgggctccatgtaacagaatataagattaaaactgacttgaaaaattgaagcccagaggtacagtgatctccagattgatgcagtaactcaacaacctcagggatccagactttccagatgtgtttccccctgccatcctctgtgtgtcacggccctctgcataacccaagatggctgtagccattccaagcatcatatgctcatacaaccctggtgggaatggggcaagtaaggccagaggggtaaggaaattctcctcaagcatctcgctatcagggaaaaagagatttcctgtaagttccttcaacaaattccttcactgatattcccaatatcaatggtcaccattgggtcaaacggccatccccatcaaggaaagaaggaaggcaagggctgtgtttttactttccaacacaggctgtggtctctgcccaactggaaaaaaaaaaagaaaaagaaaaaaaaaaaaaactagggtggcaattagctgttatgtagagaattaacaaggagcattgtaagtgttatatttcaaacaaattaaaatgcatgccttcttagccaatagtgcttaaaataaaagtacctgtattcctcataccacctgtccaccatcacctttaccctcgcctccactcacgtatacacatagagaaagcaaggactcctaatattggactgactttattttttctctttactcttcccttggctgaatttatagaacaagatcatcttacaattacagaagagatcatttattttttgcctcttagatatttgtggatttttctgtttgtttcagatgtaactaaaggaattataacaacaaaaaacagaagccaagaatatgtggtttttgtgaatatttatgttttcctgcaaaaattgaaagaaatatttaataaacattttaaaaatcatacaataaatgataactattgtatgtccttaggcatggaaagaaaattaagcaaaataggagttacacagatataaagggcataattgaagcagcttctattaactctttcagatgccatcaacataattttaaaaaccaaaggtgaatacgtattcatcatagtttaattttaagtaaataaaaattgtttctgaatagtatttgaaatcaaaatccacctatcctgaatgacttcaaagtaattaaaaagtaaaactaaaaatggatgacaaattactatctgctttgtttggcttttcaataaaaactaaatacaacacaaaataaggagagtaatttaaaattgtcatgcattataataatttatttataattagaatacttcatcttttataaaagcctattactctacctgtgtagtgtatccatctggacaagtttttctgaattccctcaggtaattagtttcatgaaacattgctggatggcatattctccctcaccactactcctgagattttataaaatacaagcactcttaccacaatgttatgttgagaaatgtaattaacagaaaatattgtatgatattcatgtcaaacattacttgggcaaaatacatatagactctaagtattcctagatgacctaattaggcaaaacaaatttatctcacaaatcttgacactatattccttctctggagcagatattcaaggccttgggaagcatttgattctgggtttaacctcccagctgcccaagaccttataccatatcacacagtgaatctatgaaatgacccagaataattcctttcagctccatttcagtaaagtcctcatctctctagtctattggtcagccccaccttcctgctggatcctatttgcaacatctttattacttgccattttggaagtcacaaactgtctcagatcttttattcatcaactcttcacccaaggcacatatgttgctaaactctctccagtaattcagaaaaagggaaacttaatttccttttgttaaacagtggcatcctactgttgtctttgcctttcctgtttatactgaatcctaaacaagctttttcatctaccaaatgttccaccaatgtctagagtttatctgtgtattagagtcttgcacccttgcactgttcttgtgcactaagtataaaacagctatttccatttaaaggtaattattgctgcagtactgcaacacatcaattaacatttttccaagtcaataatacaaagatccaagacaaaggtaaaggaaggagatccttctgttcaccagactcaagttgtaattggttttccaattaagagtggttatcctgagaaattattggttctaagactagaacgtttactaaagccacaataactttgagccaaagcaataagacaaggcaaaaaccactttaaaaaagcaatttattataatttgtatattaattcatttgttgcacatctagtaagtactcacaactttgaaaagtaagtggggaagacacagaagaaacacaaaacacagtaaatttgttaaaccataggagtgttttctattaaggacaattatggccacatgaatcaaatctccctacaaactggaggatcaataagagggaataaataaaccacacatgacccacatatttagcatcacctgaaaaaaaagccacgaatttcaaattacccacaagaaataacactaattttaaaatttctacagagctccattggcactatattctcagagagtggaatgaaagactctgtctttgagagacttcatgaaaaacaggggaattgaacagaatacatgggtgaaacagaaaaagaaaaccaccctcggaaagataaaagtcaacattaattgctaaaatactgagcacatatctgggacttcatatttcacaactacacctataggaaagggactttaaagtgagagatactggaggttgcaaccagtaactctcaaatacagacaaatacagaaaaactgtactttctgtttccacaagaaaccttgtttctggtggagaatcaaatacagaaaatacagtattggagatgtggcagtgaagagaaaaagagaaataaaaaggaaaaatataaaattattaatcctacagaaattagagaaataaaatatactcacccctctccctgtttccatcaccattagcatcatctattagagaaactgtgcttcatgataccaagaaagagggtacccttaaaactagaaatcctgtccacaaaatatctatgaatcaaatctaaaaaagcaacccagtgctatgcaaagatcctataagaagaaagtaagcaaacaaaaatgtgagtttcagttgaaacttctctcccaataaaccatacagcagaagaaaaccataactaaactccaaaataaattaatattcttaagcaaccatttagagaagtatcttttaatacatagaatcaaaaatttaagaactaaaaaatggatatggaaagaaacaggaagaaatgcaataagaatggcctgaactcaggaaagaaactgaataaaaagacaaaaccatctcataaatgaaggatgaattataagttgcacaaggaagaatagattaaaataaaaatttaataagaggttacacaggtctgaatgtttgtgtccctccaatattcacacattacaacataacctccaagtttatgggattaagaagcggagcctttagtaggtgattaggtcaggaggggtccacccccatgattcagattagtgcttttataaaagggcttcagcaagcctatttgccccttctacgccttatgccatttgaggacacatagaaggtgccatttatgaagaacagggccgtcatcagacatcaaacttgcaacttcccaggatcttgatcctagacttcccatccagaacaataagaaatacaattctgttgtctataattaattactcagtcgatggcattttatattagcagcctaaaaagaataagacagacatattgaaaaaaggtagggaaataactgaaagaataaaaaatgagaaaagaaggaagtaaaagtggtcacagagaaaacaaggcaaagaagacttggtgcacttataatgggagtctctgagaaaggaaaaacaaaattatggagcagctgtgcatatttaaactataactaaataaaactttccaaaaataaaaggatcctgaatctatgttgaaaggacccattatatatctgggaaaactgaattagaaatattctgatcaagtcctagactatcctagtaaaactattgttttaaagacaaagaaaaaatatcctcagagatcttcagacaaaatgatcaaattatctgtgagggcaaaaatattaggcttacttacattcgagttctcaatagcaacataaaacaaaatatggccactgagagattgcattttcaagaaatttaaggaaaggaagcacaagtcaagatttataccaaggcaagcttcgcttcaagaatcgactatataaaaaaatcttcaacgtgcagtaatatgtggaatatcatacacacgaaccattcctgaagagtctactagagcaatgtttctcaacttttttcccccattaacgcccctcttaggagccttttcagacctgcctacacacacatcccatcacgatgaaattttaataccttgcatatacactatctctttatatgctatggtcttttgaaagactacacaccattgtaacatctaagatttttttacccttggccccagaaaccaattttcaccccatggatgtattacagaatgaacatattttaaccaatatataagtagaaatttatggagatggactgatagagcatataacagatttgattgcggtaaatgataggggtagggaggaagagtagtatgtgtgacaaagcagaaagaatgttattccccaaaagtgagaaaatgaggaaggagagagaaagggaaaagtcaaataagatgatttatccttgtatagggaataggtggatgtcagcaaataacattcatttaatatcagcagatcagataataaaagattaagtaaaaatggtgactaaagacaacaaaaagcagaactagatataatggtaaccacaaatgtaacaaaaatacaagtagtatttggtattttgtatttgataaataccaaaataaagtttaaaatatacaaagaagtcatgccatctgaagaaataagcacagtagatatagcataatatgcacagaaattataacaatatgacaattgatacagaaatatcagtaataataagtgtggataggcttaccttgcttattaaaagaaaatattttcaaatgggtttgtaaagcaaaatatagctctatgctgaacataagactcacacctaaaacagtaattcataaagggcaaaaataaagaagtggccaatgacttactagataatggaaatcataagaaagctgaggttgcaatcttaatatcagataacataaaattcagaccaaaatgcatttttaaaggaagcagaaaatactttatagtgctaaaagctgcaattgtcaatgaacatttaacagttataaatacctgtgtcccaaatgacactgtaaacacctgtgtaaagaataattactcatacctcaaggagaaacatagaaaaacacattagtaacagaagactttaacatactactctcatactgacctgtcttaggtcaagtggacaaaaaataagtaaggttataaaaaccctaaaaattatgatagatatcataaatatatgtcaagcattacacacttataatagaaaatataccttcttctcaagtacatatgcggcattcacaaaaattgatatggtagtttataaagtatcaatatgttttatattgtacaaatatgaacaaaactggttaattttttaactatcaattattaataaatcaaaaaaaccatttcatgtaaaaaattataaaatattctattaaacaacttgtgagcgaaaggaaaaatcagaaattacagaatttccgaaaaataatgatgataaaaacctacgtattagaatctatgggatacatttaaataacaggtaagaggaaaagtcataaccttaaacatcttgaataatacaaatgaaatgttttaaaaataattataatttctaactcaaaagcctaaaacagaaaaaaaaagccaaaagaaaacacaaaaaagatcagagcagaaaataaagcataaagcagaaaacctatagattaagttaatatatcaaaacactagttccttaaaagagaagtcaataaaatgaaaaaactaccaaataatttaatttaaaaaatgagaaaacataaatgtagaaaatgacatgacttggaggaattacctcttgatatggataaaacttctttaaaaaattatgaaatactgttatatacacttctatacaattaaatttgaaaacttagattgaatgcataaattcttatgaaaataagctttgacaaaactgacattaaaagagacaagaggctttaaatgacaaatttctagagaagataccaaaattatcaataagctatctcatcaaaatcaccaggctcaggtgctttcatagaggaattctaatagatctttaaagacgagataatcccaaagctacataaattgttttagagcacagaaaattaattaaaaattctttttgaagtaagtgtaacattgatacaggaacctgatttttaaaaatagtacaaaaaagaaagttacaggccaatatccctgatgaatattgatgaaaaatcctaaataacatatcagccaacagattttaatacctcattaagaaaatatatcattatcaagtgaggtttatctaagggatgaaaggatggttcaatatgagaaactatattaatataattccctataataagtctaaaagacttattacctccttaaatcctgaaaaagtttttgacaaatttgacacccattcctaaaaaaatctctccagaaaataagaatgatgcatatttcttcagtttggatatttaatttgatttatttgacatgaaaacatgaagatacacacacacacacacacacacacacacaaacatcataccacacacatatctatgtatctacatatatatcttagttaatgaggatatgctacattcccaataggagttgggaaaaagctagaaaacctactatattcgctactgtttaatattttactggaaatactagctaatgcgattacatacaacaaaataattagatgcataagaattgaaagacaaataaaactctgtctatatgcagatggataacagtataaatggtaaactctggagaatcaatgataaaacttaaataattcagcaagatagcaagatataaaattaacctataaaattcagtaactcaaacttggcattgtgatgtgaacctgtagtctcaggtattccagggactgaggcaggagtactgcttgagccagaagtttgaggccagtttcacagctatgttattatgcaacatagcaagacacctcttaaaagaaaaacaaaataggcttcatctacacaaacaatagttagaagatataattcaaaagagaaaacttcatttatattagcaacaaaaataaaatgcctaggcataaatttaccaaaaaaagttctaaacttgtatgaagcaaatcataaaatactcttgaaacacatacaccctcccaagactaaaccaggaagaagttgaatttctgaatagaacaataacaggctctgaaattgtggcaataatcagtagcttaccaaccaaaaagagtccaggaccagatggattcacagccgaattctaccagaagtacaaggaggaactggtaccattccttctgaaactattccaatcaatagaaaaagagggaatcctccctaactcatttgatgaggccagcatcatcctgataccaaagctgggcagagacacaaccaaaaaagagaattttagaccaatatccttgatgaacattgatgcaaaaatcctcaataaaatactggaaaaccgaatccagcagcacatcaaaaagcttatacatcatgatcaagtgggcttcatccctgggatgcaagactggttcaatatacgcaaaacaataaatgtaatccagcacataatcagcaccaaagacaaaaaccacatgattatctcaatagatgcagaaaaggcctttgataaaatttaacaactcttcatgataaaaactctcaataaattaggtattgatgggacatatctcaaaataataagagctatctatgacaaactcacagccaatatcataccgaatgggcaaaaactggaagcattccctttgaaaactggcagaagacagggataccctctctcacaactcctattcaacatagtgttggaagttctggccagggcaattaggcaggagaaggaaacaaagggtattcaactaggaaaagaggaagtcaaattgtccctgtttgcagatgacatgattttatatctagaaaaccccatcgtctcagtccaaaatctccttaagctgataagcaacttcagcaaagtctcaggatacaaaatcaatgtgcaaaaatcacaagcattcttatataccaataacagacaaacagagagccaaatcatgagtgaactcccattcacaattgcttcaaagagaataaaatacctaggaatccaacttacaagggacgtgaaggacctcttcaaggagaactacaaaccactgctcaaggaaataaaagaggatacaaagaaatggaagaacattccatgctcatgggtaggaagaatcaataccatgaaaatggtcatactgcccaaggtaatttacagattcaatgccatccccatcaagctaccaatgactttcttcacagaattggaaaaaactactttaaagttcatatggaaccacaaaagagcccgcatcaccaagtcaatcctaagccaaaagaacaaagctggaggcatcatgctacctgacttcaaactatactacaaggctacagtaaccaaaacagcacggtactggtaccaaaacagagatatagaccaatggaacagaacagagccctcagaagtaacgccgcatatctacaactatctgatctttgacaaacctgacaaaaacaagcaatggggaaaggattccctatttaataaatggtgctgggaaaactggctagccatatggagaaagctgaaactggatcccttccttatatcttatacaaaaattaattcaagatggattaaagacttacatgttagacctaaaaccataaaaaccctagaagaaaacctaggcattaccattcaggacataggcatgggcaaggacttcatgtctaaaataccaaaagcaatggcaacaaaagccaaaatggacaaatgggatctcattaaactaaagaccttctgcacagcaaaagaagctaccatccgagtgaacaggcaacctacaaaatgggagaaaattttcacaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagcgaaaaaaacacatgaaaaaatgcttaccatcactggccatcagagaaatgcaaatcaaaaccacgatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacctatgtttattgtggcactattcacaatagcaaagacttggaacccacccaaatgtccaacaatgatagactggattaagaaaatgtggcacatatacaccatggaatactatgcagccataaaaaatgatgagttcatgtcctttttagggacatggatgaaattggaaatcatcattctcagtaaactatcgcaagaacaacaaacgaaacaccgcatattctcactcataggtgggaattgaacaatgagaacacatggacacaggaaggagaacatcacactctggggactgttgtggggtggggggaggggggagggatagctttaggagatatacctaatgctaaatgacgagttaatgggtgcagcacaccagcatggcacatgtatacatatgtaactaacctgcacattgtgcacatgtaccctaaaacttaaagtataataataataaaaaaagaaagatatgaaaataacacggaaaagcctactaccttattcttcataagaatatctcaacatcatcaggatgtcagttctctttgaactaatttataaattcaattcaaccccaataaaaatgctacaaatttttttttcctgcaaactagacaagttgattctgaagttcatttggaaaaataaacatataaaatagctaggaaaataactgaaaaggaagagatatgggttgagctatgagccctaccaaatatttaaaagtactaaaatgcctctgtaattaaaggtgtggtaatggcacatgactagaaagatcaatgaaatagaacagaaacagagcactctaatgtggatatttagtatgtaataaagtggtatctcaaatgactgaggcaaacagagaaataaatggtgttaagacatttgggtagacatttgaaaaaagaaaaaaatacaaccattgcccccaccatacacaagaataaactctaaatgtatcagggatccatgttttttaaaaattaagttgtataagtactagaacaaaacctaattaatgtgtctataacttgggtaaaggaaaaaggctttctaaatgtgactcaaaatccacgtgtgacaatgaaaaaattgataaatttgatcacataaaagtaaaaggtttttgcataaaaaataaacacaccagaaacaaaaacaaatgacaaattggtagcaacatttgcaatatgtatcacagaaaaagaactattatcccaaatgtataaagagcttttttaaattgggcaagggggatggaaacatgagacatcctataggaaaatggaaaaaagacatgagcaaaaaattcaccaaaaatatgtaaaaatgactttaaacatataaaaaaattaaacattataagattgacacaattcaaatgacataaatataatttatcacccatcagattggcaaaaattcaaaagttgactataatctgttggcaaagctctggggaaacaagcacactcacattgctggtaggactgcagaatgatacagcttctataaaggggaatttagcaatatccaacaaaattactatgtagcaatcccaactctataaatctatcttgaaattaaacttttaacaatatgaaaataaatatgcatatgattattcattacagcattacttgcaatggcaaaacattggaaactatctaagtgtccaaaaataggaggaccaaatatttaagcatgttcatattcaggtgggtcttagaaggttgattgaacaaactaaagtatatcaacaacatctattatgcaactgtaaaacagagggagaagatctctgtaaattgataaaaattatttccaggataccttattaggtgaaaaaataacaatgtacaggagtatatatggtatgtttcctcttatgtaagaaagaaaatgcagatatctgcttatttttgcaaaaagaaacacagtaagtttaagccagaaaatagtacaattggttacttacaaaaggtatgaaagaacagggataaaaggaatagtagagggaggatacttctctggatatacttttatgtatggttttgacttttgaaatgtgttactgtccttcatattaaaaaggtaaaattaaatcagtaaggatggcagtagaaaaagaaaaaaccctaataccaaatgcaaacagaaacatataaactcaactgaatttattttatgttacccaggctagaacacagtggcacaatcatagctcaccacagcctaactgcccaggctcaacctaacctttcacctcagcctcctgagtagctgggactacaggcgcacaccaccacacccagctctttttttatttttgtagaggctggttttgaactcctaggcccaagcaatctatacacatcagcctcccaaagtgttaatattataggtgtgagccactgcaccctgcaatcctactgtatttcaaatgaatgttgtaaacacactgaatgggaaaaataaaaggatacgtttaattaacttttgaacaaaagactttgactgtatacattctcaatccaggggaaaaaagaatggcaagcaaatcttgaactctttcatacatttgtttttataatggtatgtctgtgtagcaattctgaaaaaattttttgtgtcttttaggtttgagaaaatgagtaaatgtgtttgtgttgttggaagctgaagttcttactgtggagaaaggaacatacagatatggaatcggggaaggcaagaaagaatcctgtgggttcagctgaaattggcagcagttcaaatctgtgattttgcaaatagatagatagatataggtaggcagataaagacctagaagcaatgacacacccatagcaatgagcacacctagcacccaaatcttggtttctaaataccattccccagtaaaggatcagtgtcccttggacaaatgattgattccactgctaaagcaggcaaggtataaggtgagactagaacatcttgttgttccaataagtatgtgtaagaaatgtttcaatcatcagtaaaacagaggtgaattataatacaagatactgggtctcaccttttcactcaggctggagtgcagtggcaagatcatagcttactgcagtctcaaatttttggcctcaagcaatcctcccacctcaacttcccaggtatctgggattacagccatgagccaccatgcccagccctgttttttttttttatattcgactgctggcaatttttaggctttacctctccctcttgctgttgtgctgtacctgtcaatagctggaaagaaagccttggcactctttccttgtttgacactgatcagggtttcaaaccactgaagtcccatagggtcattatccatgcaaactactctcaaatggtacagaaaaaatgtattcaaatatatgtatgtgatgtgtgcatatatcaatctacatgtctaccaatctatacttatgtatgtctatcagacctagatagatagttatagaggattgaaagagaaagattaaacaaatgtggcaaaatgactaaaaactagtcaatctgataaagagtataattggacatctctgtattattctttcagctgttctctaagcttaaaattatttcaaactaaaaagcttaaaaaagtatgggatatgacaccaagataacaggtaacgaaataaaaaatagataaatacaacttcatcaaattatcagtttatcaagatagcaaaaagataacctacagaatgaaagaaaatatttaaaaatcatgtatctgctaattaatatctagaatatataaagaactcattcaactcaacaaaaaaggaagtaatccaattcaaaatgggcaaaggacttgaaaagatatttttcaaaaaaagatatataaatagccaacaagaacatgaaaagatgcttcatatcattcgttattagggaaatacaaataaaactgcaatgagataacactttacatctactgggatgcctaaactaaagaagaaaaggtaaaataacaagtgctggcaagaatgtagaggaattgaagccctcgtgtattgctggtgggaatgtaaaatgatgcagccactgtggagaacaatttggcaattcctcaaaaagttatagaactaccacatgacccggcagtttcactctcaggtgtgtatcccaaaacaattgaaaccagggattcaaacaggcatttgttcgccaatgttcataccagtactattcacagtagccaaagatgtaaacaacccaatgtccatcaatagatgaatgcataaaccaagtgtggtatatacacacaatgaaaaattactcagtcattaaaagaaatgacatattgatacatattacaaaataggtgggcattgaaaatatagtataagtgaaataagccagacacagaaggacccactgtaagatcacacttacatgaagtatgtagaataggcaaattcatagatagacaaagtagaattagagataatcaggggctgagaaggaagttagtgtttaatgagtacagagtttatgctgggatcatgaaaaagtttggagtatagatttaagaggatcatgacagacaggaaaaagtactagattgcagctcccactcagatggacagagcagcatgtggagcctcgtgtcatgaacttttgctccaggactactgcaggaataaatcaggaaagtgaagagaactcacaaattctctgaaggaagtggattgctcctgcaggacccaggagacacctcaaatactagcaggtgtggaatccagggatctgcagacagttcacatcacagaactttgtgcagacaacccccagtgttagcctgaagcctggtagacctgctgggtgattggatccagaagagagataacaatcactgtagcttggctcccaggaagccacatccctaggaaaacagggagagtactacatcaagggaacaccccatgaaacaaaagaatctgaacaagagccttgagccctaaaccttcccagacatagcctatccaaatgagaagaaaccagaaaaccgactctggtaatatgacaaaacaaagttctttgacacccccccaaaaaatcacactaggtcaacagcaatggttccaaaccaagaagaaatccctgatttacctgaaaaaagaattcagaaggtcagttattaggtaaaacaaggaggcactagagaaaggcaaagccagtttaaataaatcaaaaaagtgatacaagaagtgaagggataaatattcaatgaaatagacagcataagcaaaaacaatcagaacttcaggaaacaattggcacacttatagaaatgcaaaatactctggaaaatctcagcaatagaactgaacaggcagaagaaagaacttcagagctcaaagacaagattttcgaattaacccaatccaacaaagacaaaaagaaaaaaaaaaaagaataagaagacatgaacaaagcctccaagaagtctgggattatgttaaacaacaaaacctaaatgtttgatataaaaatacttctaggaataaatgcttggtgccacaaagtgaaaccagcactcaggcaaaagttgtctcagcaaggcaatttacttctgcagaagggtagcactcccatcaactaagattgcaagagcacagagagcaaaggagaccaggggttttttatctccttaacacaatccctacctcggtgtccctcccccatgggctggggtcagacgcacaatctgagctgagccgattggctacttgaaaatatttttctaaacatggaaggcaagggggacatggggtacagtggcaaagcttgtgagatgtgcagttttgggggaaaaatgggtgcaggtaaccaagggaacagatgtgagttattgattagagctgatgggaagggggtaggctgttttacagtaactagggacaaggagaaacaggaaagttgagtttgagaacaaaggacaaggaagttagcagactaaatctttgaagagaaactcagaaattcattgtatctttcataagaataatcagtgttcctgaggaagaagaaaaatctaaaagtttgtaaaacatatttagtggaagaatagaggaaaacttgcctggccttgctagagacctagtcatccaaatacaagaagctcaaagaacacccaggaaattcatgcacaaaaaggttactgcctaggcacattgtcatcaggttatctaaaattaagaagaggaaaagaatcttaagagctgtgagacaaaagcaccaggtaacctataaaggaaaacctatcagattaacatcagatttttcagcagaaaccctacaaactagaagggattggggccctatcttcagcctccttaaaggaaacaattatcagccaagaattttgtgtccagcaaaactaagccttataaatgaaggaaagatatactctttttcagacaaacaaatgctgagagaatttgccactaccaagccagcactacaagaactgctaaaaggagctccaaatcttgaaacaaatcctggaaacacatcaaaacagaacctctttaagcataaatctcacaggacctataaaaaatacaataaaaaaaaacaaggtatacaggcaacaaatagcatgatgaatagaatagtacctcacatataaatactaaagttgaatgtaaatggcctaaatgctccacttaaaaggtacagaattgcagaatggataagaattcaccaaccatctgtctgctaccttcaagagactcaccgaacacataaggactcacataaacttaaggcaaaggggtggaaaaagacattccatgcaaatgaacaccaaaagcaaatgggagtagctattcttatatcagacaaaacaaactttaaagcaacagcagtttaaaaagacaaagaaggacattatataatgataaaaggccttatccaacaggaaaatatcaaaatcctaactatataagcacctaaaactagagctcccaaatttataaaacaattactactagacctaagaaatgagctagcaacacaataaaagtgggggacttcaatgctccactgacagcactagacaagtcatcaagacagaaagtcaacaaagaaaaaatggatttaaactataccctggaatgaatggacttaacaaatatttacagaacattctacccaacaaccacagaatataccttctattcatcagtgcatggaacttcctccaagatagaccatatgataggccacagtacaagcctcaataaatttaagaaaattgaaattatatcaagcactctctcagaccacagtggaataaacctggaaatgaactccaaaaggagccttcaaaaccatgcaaatacatggaaattaaataatctgctccggaatgatcactgggtcaacaatgaaatcaaaacagaaattaaaaaattcttcaaactgaacaatgatagtgacaaaacctctgggatatagcaaaggcagtgctaagaggaaagttcatagccctaaatgcctacatcaaaaagtctgaaagagcacaggcaatcttaggtcacaccaggaactagagaaacaagaacaaaccaaacccaaacccagcagaagaaaggaaataaccagtatcagagcagaatttaatgaaattgaaacaaacaaaaacaatacaaaagacaaataaaacaaaaagctagttctttgaaaagatagataaaattgatagaacattagcaagagtaaccaagaaaagaagagagaaatccaaataagctcaattagaaatgaaactggagatattacaactgacaccacagaaatacaaaagatcattcaaggctactatgaacatctttatgcacataaacttgaaaacctagaggagatggataaatttctggaaagatacaactctcctagcttaaatcaggaagaattagataccctgaacagcccaataacaagcagtgaatttaacatgaaataaaaaaattaccagcaaaaaaaagtccaggaccagatggactcacagatgaattctaccagacattcgaagaagaattggtaccaatcctattgacactatttcacaagatagaggaagagggaatccttcctaaatcattctgtgaagcctgtatcactttaataccaaaaccaggaaagacataactacagaccaatatcttaatgaacatatatacaaaaatccttaacaaaatactagctaactaaatccaacaacgtatcaaaagataatccaccacgatcaagtgggtttcataccagggttgcagagatggtttaacataaacaagacaataaatgtgatacaccacataaaaagaattaaaagcaaaaattacatgatcatctcaacagatgcagaaaaaacatttgacaaaatccagcaaccctttatgattaaaactcagtaaaattggcatacaagggacatacctcaatttaataaaagccacctgtgacaaacccacaaccaacataatactgaacggggaaaagctgaaggcattccctctgagaactggaacaagacaaagatgcccactctcaccacttctcttcaacatagtactggaagtcctagccagagcaatcagacaagagaaagaaatcaagggcatccaaattagcaaagatgaagtcaaactgtcactgtttgttgatgatatgattatatacctagaaaaccctaaagactcctccaaaaagctcctggaactgataaaagaattcagcaaagtttccagatacaaaattaatgtacacaaatcagtagctctcctatacaccaacagtgaccaagctgagaatcaaattaagaactcaaccccttttatagtagctgcaaaaattaaaaattaaaaatcaaaaaataaaaccttaggaatatacctaaccgtggaggtaaaagacttctacaaggaaaactacaaaacactgctgaaataaatcatagaacacacaaacaaatggaaacatgttccatgctcgtacataggtagaatcaacacagtgaaaataaacatactgtcaaaagcaatctataagttcaatgcaattcccatcaaaataccacatcattcttcacagaactagagaaaaacaattctaaaattcatatggaaccaaaaaagaacccacaaagcccaagtaagaataagcaaaaagaacaaaactggaggcatcacattatgtaatttcaaactatactagaaaaccatagtcaccaaaacagcatgttactggtataaaagtaggcacatagaccaatgtaacagaatagagaacccagaaataaaccgaaatacttatagccagctcatctttgacaaagcaaccaaatacatcaagtgaggaaaggacatcctattcaacaaatgatgctggataattggcaagccacatgtaggagaatgaaactagatcctcatctctcaccttatacaaaaatcaactcaagacggattaaggacttaaatctaagacctaaaattataaaaattccagaagataatgtcggaaaaacccttctagacattggcttaggcaaggatttcatgaccaagaaccgaaaagcaaaagcaattaaaagaaaaaaaggataaatagctgggacttaattaaactaaagagcttttgcactgcaaaaggaacagtcagcagagtaaacagacaacccacagagtggaagaaaaacttcacaatctatacatctgacaaaggactaatatccagaatctacagcaaactggaacaaattagcaagaaaaaaaaaatcccatcaaaaagtgggctaaggacatgaatagacatttcccaaaagaagatacacaaatgggcaaagaacatatgaaaaaatgctcaacatcactaatgatccaggaaatgcaaatgaaaaccacaatgcaataccgccttattcctgcaagaatggccataaacaaaaattaaaaaataatagatgttggtgtggatgctgtgaacagggaacacgtctacattgcttgtgggagtgtaaactagtacaaccactatggaaaacagtgtggcaattccttaaagaactaaaggtagaactactatttggtccagcaatcccactactgggtatccacctagaggaaaagaagtcattgtaggaaaaagatacttgcacacacatgcttatagcagcacaattcacaattgcaaaaatgtgtaatcaaacccaaacgcccatcaaccagtgagtggataaagaagctgatatatatatatatcagtttctgaattttttatatatatatatatatgatggactactacttagccataaaaaggaatgaattaatggcatttgtagcaacctggatgatattggagactattattctaagtgaagtaattcaggaatggaaaatcaaacattgtatgttctcactcgtaagtgggagctaagctatgaggatgtgaagacataagaatgatacaatggattttggggactcagggggaaaggtgggaaggcggtagggataaaaaacgacaaattgggtgcagtgtacactgctcagatgatgtgtgcaccaaaatctcaccaatcaacactaaagaactcattcatgtaatcaaagaccacctattctccaataacctgtgggaaaaaagaatttaagaaaagaaaaagtttgaggtatagagaatggtgatagttatacaacataatgaattacttaatgctactgaattatacacttacaaatagttaaaatgataaatattatgctatgtatattttagcacagtttttaaaaaatcaaaaaagaaatatatgtgggaaaattattatgttactttaaatacaatgcaagatacactaaaaaccgtcaaagtgctctctgtggcttgaatacaaagaatctgtcacacactttctttaaagcaaacaaacaaatattaaaaccttagtattttaggagaaagaagactctcagttttgaaataatgatagaatttacagtgtgttattactctttagtgataatctaagtaaactgtaagttcctttagattgaaaatcatcaattcacttacctttgtattccaagatctgttattagataaataactgtatgatggaaggatggagggatgaattaattagactgaaggtttaagaagctttgtgggttagagaaatactaaggtctgaaaaagccagagaagagatcatggagagggtgtgagctgagctaggaaggatgtggaggatttggaagggcaaaaagataaagtgaggacccggtgagagagaaatagagaggtactgaccagtctcatgcttccatgaaaccgtaacaacacttgggctttttcgttcgttcttaccttagaggcacatgctaaaagctaggtttttcaggtttttggtcatggttctaggctacggttccatgaagctcagatttgttaggtgatcttgaggcttaaaaatgaaatagtgagtcttttcttctatttgccccaattgagccatttctgagtataatatcttctgatttacttcattttactggaaaaggtcaaatgatttatgatttataacattatagctgtgatttcagttagatgaatcagatagtaaatcataatcacagaaaaacaatcaacagccttgtagatcagtcagagaatattctacctgaaatttccagtataaaaagagaagtcaataaaggttttggagagtaataaaaaacctttttcagaaatgtagtcattaaaataacttcctataatcttccccactagaaataaactcggaaagggactggaaacagcaatggctggaaacacagtgtactatcttgccgatgagaagtgccaaccatagacaccgatgaagatgcataagttttatttccaggaattcagccaggggtataaatgaggaagttagacattggtgactatgggtcttaggtctactttgcttgtaaacgttgactttcatgtctatttttcccttgctagtttgagaaaatataaatgtattgaaatgtaaagatactaaatacaaaaagcaagttgaaaaatctgcaaataagcctattaaatatatgcttatgaataaaagctttagaattctgagaaatatgcaccaaacttctaacagttatctaaagtgtgaggatggagaagtgtggaaaattagaacttccttactatccattgttccttatatgttttaatagtagcaatatttattaacacagtctttactatgcactcttcttagtctttgattcacagaaatgtctattttaaattattaccatggttattttgaccataggtctccatagcaaatattagattggctgacatttatttttactcatttctgtgaagttttttacttttacttattatctttattcttgatataggccatttgttaaatatctgtttgtcaatttaagttcatatctgtagtatgactttttatttaaactttcaaaagtaaaaaaaaggccttaccaggccagatttcctgatttctgattttaaaaatgttaatccaaacctgttattaccgtatttacttcgccttttttcctgccccaacctctctagaaagaaatatccttttccttcctctaaattatttctcaccagcagttactttgtcttctttgttgcagcagaaaaatacctactctacaggctgaggtcagagccaccaaaagagcacaaatgaccctttttctgagcagcaggaatttaggtagaggtgttgaccccgttagatgatctgatcaagtcttgagaggaagtgagtggtatgtttggaacatatagagtcagatgcaagattggggaaccaaagtgtatcctggagtagctataagtccttaattgatcctttaggctatgggtgagcaagaaattaaataaacagattctaaaatataagtagattaaatagattctaaaatataaagaaaacatgcaagacaagaaaactagtatctattgagagttgactataccacatacagtatactattatactatttacactattatgtaaattttcacaatgactttgaaagcaagaaataagcatctctcttttgaagatgaggaaaactgagtcactgagaaattacggagattgccgaggggacacgctcagtaagtggagagccaagatttgaacccctatctatctgcctccttacttttttacactatacaataataccttaattcaagtcaatattcaacctcaccattctaagtaaatgactgtatcacttacagcatctgctattaactatagagtctggattgataaggttcagtttgttcctttaatataagtgtaaatattttcagccttacaagtacaggtaaaaaggttaatgatctgaactgttcagagtgaaaccatcttcacagtacttcttacaaacaaaatcacactggctttcctaatccaatttcagcaagagaaaatgtttcttaaaagacagtaagtcatggtaaggtcctataacctatcagctgttactgtcctttgcacctcctgtcctcgggtgctagactgctgtctgcctccccagtgcagtgtgcaaagggctttattattaccagctgagagccaaggcagctgaagggtacactgtcactacagtttgctcccccacatgtcaacatattctgaaagctactgacatctgattttaactccttgctgccttctgttcctctgactttgacagattttaatgagacaaatgctagctgtgggtttcctttttccaccttcccctacctcacccctcaggaactcacttttctgctgccatcctttgtgaaacggcaaactaaatatgaaaaactgctgataaggaggaatagacttatgcccagaggataaacttaacagagctcacctagcctggctggcattgacccctgcctctacatttttagtacatgtctcataaaagagaaactgcctgtgcttctaggattcttttatataagtgccaggagatgtgtcaagtacaacttgcttctccaacatattgatacatttagagtttttaaagaaaactcaagtgagtcagcaggtatactctcaagccacatacctaggaggatgctcagaataactaccctttactgagcaccatactactatgactccataagaccagcttgggctcagaaagacctgtgtccaaaatcacacttcaatcacttggggaatcttcttcaaagagtttgaaaaattcccttgcatatggcagacctccagctaggtaaagagaattactgtgaccccctctatcccctcatttcccaccaggtttcctaatatctcaatttagaaactgaaggttgggggcagctggaagagaagaccgtagaaatcatgagtaagtggaagacgactcttggggcccaaggggactgtgccttgcttgtctggaaaacaaccactcaggcatattgcccttcagtacagaaccatgggatgtcttcagggcaagggttctgaggtagtgcacaccataccctatagcttgaccaaagcacgctagagaatgagaagtcccacatgccccaatcggagaaaaaaaggaatgaaatgtcctggtgtacggacaggtggtccagaacatgagatcatcatgactgatggcggtgataaaatattcaaacatcagcagttgctggtccatgcccaagggccagatgggacccatttcatcaccagcagagactggacaaggacacagaagctagggagccctcctcctggaaccacgatgttgtttttgaaagcttccctctgtgcacagatgtcttcccaaagaaaggaagaaggaaagggaaggggaagaagccttcaaagacagtgctttatcccaaagtgaatagattgagactgagataataacatttaaattgactagaaaaaaatcagcataacaaaatggagtagaatagactatatgctctaggacagactgagggttaagtgcaaaactaagttttgaattgcagagtgtgctagtattacctgataaacatattgcttctatttctctctaaatattgctaaaaattattgaacagaactgcacaaaagggagtttggcacacttatgaccaaaaatttttcctaagatgacattaaaccacaaatcaatatccactggttatattggttcaaccagtaaccaacacagtatatttacagtcacccattgtgctccagatgtcccatgaggacatcagtaaagattttggccattgcctggctaaaatcaacatacacaaaatctagatagagtgtggtataagaaacaagtgtaggttgtggagttagaaaatctctctttaaattccacaatttactaggaagattgtaaaaatttacttaactcctctatgatttctttttttaaaagttttcttgtttgtaaattgagggacaaattcactaataacacctgattcaagacttgctattatgatcagctgaggttacacattttataaatattaatcaccatatagatattggttattatctcttaataaatggatgtcttatttaaatctcattattttaagaaagaaatggtgtgtctgttacccgtctttgtaataaactcatattgacttccagtgatctccatttaatttttcaagtacttataaaccatccatttttaaaaattcatccaaaaatttttccaagggaagtttcagaaatcctttgtctttcctactacttttgaaaataaggactttttggcatgtctccagttcttaataattccatggagattattggcatggctgaatgatcacatttagaattatttcaagtttcccgatacattaataattagagcctaaagacttgggcataagttttgctatctggttcactcctcaactaacctgtgcttttcctacatcaagggaaacacacaaacctccaagccatgtaggtttgctcctcttcagtttaaagataatattccttaacacagaagagaagacaaatggaaagttaagagctttgctttctcttaattttcttgtaatagcatagcttgccactaaaagtgagctgtttcttccccgtttctcttgcttgccctgaactaagcttacagtgggctctgtcctttctgacactgacaccttcttgagagcagggctcctctttggcagctctctttggtcatgagcccctcctgccaccttcagcacatgttcatgtcaaaaagaaattgtcttcagagacagtccatgcagaaaaattcttggcattcgagagaaaactccaggtaccaaattggagcccagattgttagggatactgactaatagctttgtagttaactagtctcaagttcaaatcctagttcttacaatctacagccgtatatccttgggaaataaaaatatctctctaagccttagttttctcatctgaaaaaaaaaaagaaaaaataaagcctatatcatcaaatcatataggactaaatgtgatgatgtattttaaagtccaccagcactgtcatcctgctctggcggaaacataaagaagcgtggtagatgacttcaaactatgctacagggttacagtcaccaaaacggcatggtactggtaccaaaacagggatatagaccaatggaacagaacagaggcctcataaataacaccacacatctacaaccatctgatctttgacaaacctgacaaaaacaagaaatggggaaaggattgcctatttaataaatggtgctgggaaaattggctaccgtgtgtagaaagctgacactggatcccttccttacaccttatacaaaaattgactcaagatggattaaagacttaaaggtaagacctaaaaccatacaaatgctagaagaaaacctcagcaataccattcaggacataggcatgggcaaagacttcatgactaaaacaccaaaagcaatggcaacaaaagccaaaattgacaaatgggatctaattaaattaaagagcttctgcacagcaaaagaaattatcagcagaatgaataggcaacctatagaatgggagaaaaattttgcaatctatccatctgacaaagggctaatatccagaatctacaatgaactcaaacaaatttacaagaaaaaaccccattgaaaagtgggcaaaggatatgaacagacacttatcaaaagaagacatttatgtagccaacagacatatgaaaaaatgctcatcatcactggttattacagaaatgcaaatcaaaaccacaatgagatactatctcacaccagtcagaatggcaatcattaaaaagtcaggaaacaacagatgctggagaggatgtggttaaataggaacgcttttacactgttggtgggaatgtaaattagttcaaccattgtggaaaacagtgattcctcgagtgattcctcaaggatccagaactagaaataccatttgacccagccatcccattactgggtatatacccaaaggattataaatcatgctactataaagacacatgcacacctatgtttattgtggtactattcacaatagcaaagacttggaaccaacctaaatgtccatcaatgatagactggataaagaaaatgtggcacatatacaccatggaatactatgcagccataaaaaatgatgaattcatgtcctttgcaggaacatggatgaagctggaaaccatcattctcagcaaactatcacaaggacaggaaaccaaacactgcatgttatcacccataagtgggagttgaacaatgagaacacgtggacacagggaggggaacatcacacaccagggcctgtcggggcgggggtgctggcagagggatagcattaggagaaatacctaatgcaaatgacgagttgatgggtgcagcaaaccaacaggcacatgtatacctacgtaacaaacctacacgttgtgcacatgtaccccagaatttaaagtatgatacaaaaaagaagcatggtagaaaagaaatgaattcacattcatgtataagtataaaggcagaaaataaaacttcatgataagaaccaaaatggtaacaataggtatacattgggccacaatctttttacttgtctgaatgttctaagattcctttaagaggcaactattccttttaaagttgatttgtaaaatgagcttaatagttcagtcctctctgcaaaaagataaggcaggattttttttaactctcatgttttaaaaagtctcttagaagaaacactccctggggagaccacagttttgaactgaacctaaaatctagatctaccttagtggctcgtacctggacttgggaaaaggaattctatcttcacgggagcatttagtgagctctgattgtgtaaacatcccaaagataggtgtggggagaactaagtatcatagctgattcctgacctcagggagtgtttggcacagctggaaagagaagattaaccataatataagtaagtgccctattttgtattatggatcataaatataagaaagaagatcacagaagttgtgatgagtgcagagtgaagcaggatgtcctcaaaactgctttctacagaaacacagccatgttcctttggagagttgcttactggcaactaaactatattgcttactagcatgttggaggctctgagaagacagcagaaaaggaacctgcttaactttgaataacaattatttcctaaacatacttgacaacagaagctcctttttagggaatgcttttagcaacttgtagagttgcccaacctcagagctaatgctagcaagaacagattcatgcaggatatgcacttgctctgggccttgaagaatgggtaacttttagatgagcagaggatggaagaggcttcagaggatggaatcatttgggggatgaaagcatagactcaagacatatctatggtcaggactgatcttgagagctagaggtaggcctagagggagagagggaaagggtcaagtagccccagattataaggttcagaagagtgtagatcaatggttttcaaaatgcaaaccttgtatcacctgcatcagaatttcactggtgctagttaaaaagtactcagccccatcaaactcaaaagcttctacatggtgaagaaaacaatcaacagagtgattgagagaaatacaattacagaatgggagaaaatatttgcaaaccatacatctgataaggggttaatacacaaaatgtgtaaggaactcaaactactcaatgataagaaaacaaataacccaatttaaaaatgggcaaagaacctgaatagacagttctcaaaaggagacatacaaatggccaacaggttcatgaaaaaatgctcagccacattaattatcacggaaatggaaattaaaactacaatgagatattacctcatacctgtttgaatgcctattgtcaaaaaaagcaaaagataggctgggtgcagaggctcacgcctgttaatcccagcacttttggaggctgaggcgggcagaccacgagatcaagagaaacgagaccatcctggccaacatggtgaaaccctgtctctactaaaattacaaaaattagccggtatgctggtgggcccctgtaatcccagctactcaggaggctgaggcaggagaatcacttgaactcaggaggtggaggtctcagtgagctgagatcacgccactgcactccagcctggcaacagagcgagactccatctcaaacaaacaaacaaaaacaacaaaaacaaaataaaacaaaaaacacaaaagataacaagtgctggtgaggttgtgaaggaaaggaagcccttgcataggctgatgggaatgtaaactagtacaaccatatggagaacagtatggagggtcctcaaaaaatcaaaaatagaactaccatatgtgatccagcaatctcactgcttgagtatatatccaaaggaaatgaaatcagtatgtcaaacagataactacactctcatgttcactgcagtgttattcatgatagttaagacatggaatcaacctagtgtccatcacagatgaatggattaaaaaaaatgtggcatatatacacataaaatactattcaacctaaggaaatcttgtcatttgcaacaacatggatatatctggaggacattatgctaagtgaaataagtcaggcacggaaaaacaaatactccatgatctcacttacatatgaaatctaaaaaagctgaacttacgcaagcagagtagaatggtggttatctgtgttgagcagggagggatgttggggagatgttggtcaaaggatacaaaattgtatttagagaggaggaataagttcaagagatctattatgcaacatgatgactatacttaaccgtgtatcgtattcttaaaaattaccaagtgttctcaccacacaaaaagtatgggaggtaatgcatatgttaattagcttgattaggacattccacaatgcatccatatttcaaaacatcatattgtacacaataaatatatacaatattatttgttaatataaataaattttaaaaaaagaaaaaacaggccaggcatcgcggctcacgcctgtaatcccagcactttgggaggccgaggtgggcggatcaagaggtcaggagatctagaccatcctggctaacacggtgaaaccccgtctctactaaaaatacaaaaaattagctgggcgtggttgtgggcgcctgtagtcccagctattcgggaggctgaggcaggagaatggcgtgaacccgggaagcagagcttgcagtgagccgaggttgcgccactgcactccagcctgggagacagagcgagactccatctcaaaaaaaaaaaaaaaagaaaagaaaagaaaaaacattactcagcccccaacctcagatctactgaaggcggtcctgataatttgcattttaaaatagcccccaaggtgactcaagcactctaaagtttgtagagactggaagccaggtagggaagggggtaaaaagctagatttgattgcaaaatgaagcttaattggaaaagcagacacccccacactcaggcatttatttatctgagatgtactgaactccagctgtatgccagtccctctccaaggtctcagtttgctttgcttttgtgattggaagaaaactggttcctggcctcttggggcttacaccaagtggtcaattaaaatacatgtattgtttaggagccttggagttctgtcttgggtgccatgatgaggcttccttagctcactttctgaggagggggccggccttaagaataatgagtccactgtgagcacatagcgtaataggggggactctttaggagctccaatggcccctgatcatttgaccagtcttgaaaatttgatgtccaccttgtttctgaggctcatctctacctagtgccatattcaaagaagtagatttttgccccagtcgatttccctgtgcctctatcctgtttaacctgcttatctctgaacacttatctctgtagtgtctcttctgaccattctgactgagatattctaaccggggccctacttactgtctggcttacctccctggtacggactctctcttcaccatctgtcttcctggagccacatggatggctacccccagattctcaaccactttgcctggaccacctccctactccaacacattgaactcatcctttgccagctacctacctgaactacaacctacttttgctgttgattcaggtgattttgtagagtcagctttatggttaagcattcccaagttcaaatcctaatttttacaatctccaaccgcacctccttggaaaatgaaaatatatctttaagccttggttttctcatctgaaaaaaaaagaggaaaaataatgcctatctcctcaaattatataggattaaatgttatgatatattttaaagtcctagtacaaagcctggcacagagtaagtatttaatcaacgagagacatttttattcatcttgggcatctttaccctccagattataattttcctttagcaattacatccatgcctgtttctacaacttcattctgacctttgggcaggggtgtgggtgggagtggagcatggggatcaagttctgagtcttgtccctatgcacactctccaaaaatggcatctctatgaagattttttaaagtaatatgctgactagactagaaaaggcattttgagggaaagctaggcctggagacagtgctccctgtctcatgagccagcagagctggtcctattctcccccatccccatcccatcccatccatgcacccaggcttatttccagtggtgtcagaacctggcttggcccctagcaccattctataatggaacagatcttggctgacctcaaatatggcattgttttgatatgcccataggttctacataagacctactttttaaaaacaaagtttttttttatcattcacttaattacccagtaatttgccaatcaaaacttggtggacatttttcagaacagatagtaaaagagagaattctctgcctttattttctccttttcctgaccccccgttgcttactcaaccaagtccaaacttctgagcctggagtacaaagtcctgaatgatcacgctcactttgcctacctcaacagcctcatctcatgcccttcctctattcttcagctctcagctgcagtcatgcttcaattcttgcagttctagaacttcctctctccaaatctctttgttcatgctgctctgtctccctgcctacattctctccagttctttacctggaaaactttcattcaaagttgaagactctgtccaggggtcacttcctctaggagtcattccctctccttctcccattcttagctaggtgcattcctttgcacccacgacatctgagcatcttgtggcaatgcacttctcagaccacaccataattaatcatctgtttatggtcagtctcccctagacccttgctactcaaagtgttagaaatgcagaatctctatgcccacctcagacccactgaatcaaaattttaattttctcaggatcccacatgattcctccgctcatgaaaatgtggaaagtctgctttaacagttagactgtgcagatcctcaggaggtgggactgtctttcatctctgaagccccaacaatagcacagtacttggcacatcatagggctgaatttggcatcatgcctgtgtcctgatccccacctggcctcttggattggttttctatcctgtcagaagaggattagagtcagaagctcttttcaagggaggccttgtagaatttctgctacaaacagtgtccatgcgacaaggtgcatccccaaattagagaacactctccacttctcttccagggatccagtgctgctggacagtggacccctggtttccttggagttcccatcttgggtgccatcatgaggtttccttagctcactttctgaggagtgggccagccttaacaatagggagtctgctgtgaacaaatggggtgggtcaggggcacccattaggaactccaagtaacactttagggatcattgcaggagccaaaggtcctgcatgagcaaatgagagcaagagtagtgtggtaagcagaataatggctccccagctacatccacattctaattctcaaaatctgtgagtgttactttacatttatgtatatggtgaaaagggcttgaaaattttattaaggattttgaaatggggagaatagcctgaaatgatcttggtgggcttgatgtagtcacagtggtccttacaagagggaggcagaagggtcagagtcaggtaagttggggaaatgacaacagaagcaggagctaggatgacgggagaagaagccacgagctaaggaatgaagatggcctctagaaactggaaaaagcaaggaaacagatgctccctagagctgcctaaaggaacgagtcctgctggcacatggattgtagcccagtaaaactgatggtaggcttccagcctccagaaatgtaacaggaaaaatgtgtgctgttttaagctaccaaatttgtagtaatttgttacagcagcattgggaaattaatacaagcaggaaatctgagttattcatattaatgtgagttcctttgtttacacaagctgttataatatctgggttacccaagctaaactcccacagttctagactgccagaaattagggtggcttttctttttttttcttttttttttttttttcccagttgatttgctcttagagagttccaggagaaaacatgcttccttcgggatgttggttgggaaaagcaagaagttggttcgatctcaattttcaaaagatccagtgtttttaaagcagatttactactccacacaagaatgctctcccaaaggcatttctagcctaaaaccccaagtagttcttaagagccagagtttccagagaacaacaatgaagttgtcatcctgtgttgataaatcgactgctgggagctctggaggcttggtggggaaagccagtcatcataactgggtagtgaaagtccctgggaccatcaatgccgaaaaccagtagcttctattaataaatcaataccttcccataagaactttatttttttgttattgttggtttatggaagaaatcttaaagaaagaaagtgtggggagtgggcaatgtcagatctgtctagaccatgaaatccacctgacattatgattcttaaggaccatttgagctatcccctttgaaagatctcattaaaagtggagctctcaacagctttgaatttcacatggcatgagcctccctttggagagctaacaatggtctagatgccagagaatcccaaatgctgagcagtttccttggtgtccacagctaaagctactttctcaaggtctctgcaaatcgcattactttagctacggatttctgattatgatccccctggaagaggtttctcctaagtttccagccctagaaacaagtggcagtgactgcacaattctgcctctgaaagggaatgctcatcttacctgcctggagcagcattctcagtctaagggtgctgggaggggaggggagatgggctattcattcagactcgaagacagccagagtgggactgatccaagcatccaggaggaatgacagcttaattcccggcaccccactgggaagccatggcaggggttaattaatttcctctccagcggttccctgggagagtttgcattggttcatagctgtgtgaacccgcaacactccctgcatgaagcctggcaaaagaggcaaaatgagcttgtatgtggttgctctgctggtatctttgtttctccatttctggagataagtcaggtaactcattgactatgcttggaagggactatgccagggcagtcctcagggaaactgcaaaatagcctaggttttcctctggcttgtcaagacaatccttttagggcccatcctcctacctctctcagatctttgtcctaccaaattaataaaggtgaaacttcagataataattaaaaatttttaatcatctattgtgtttttcaataaacatataaatgtctaacctatgccagaagctggtaagaagcgatgtaataagggaagtaacatttactaagcatctaatatacatcatatattgtgctcatttatactcataactctctggagaacatactcctactagtcccattgtttagagaaaagtgaggctcagaaaggttaaataatttctcccagcatcatacaactagtaagttatggataaatcaagaatttgaacctggtctgttggactccaaacctgtgctttttctgtattagtcatgagcttgaaatctggaattaaaaaataaaaattaaaaaaatccctagatttaaattctggctttgctacttagcaattgtatgacttcgggaaaattatgtaaattctctgagtgttttcatctttaaaaagggatgacaaaaatggtacctattcacaggattaatgaagattagataatgtttatacattgtttagtacagtacttggtacataaaaagttctccaaaagtgttaactgtacacaattatttttccatgctcttctcaaggagcttgctctctaacagcaatttccacactaacattcttcccgtctctaaaacttcaatatttgtgaattgactttgaaagattatttcccctgcagcaaaaatctcagataaagtgctctttgagtcacttagggtcataaaattggcctaatcaaggtgtaatcaccatgttttccggaccttttttttttttttgcaggacagacaagacctttggatctcttacttccattcataaaaacatctattattgcttttagcttataaaatatcattgatgatctccttagtaagtatgtagtttatatacttactgtttctgcggacataaaaatatctcaaagggttttgcacaatcacatgcaacttcaagatcctgattcactttttcctataaataagttcataaatggtgccttcccgtgccagcatgatttatgggaccataatcctcaccagggataagtacactataggaggtgagtgcctaagaccagaagtgaggtgtaactgcacagctagtccagaaagcattccgacagtatctggagaaactaagagagtttattccctatggctaggtaattacattctctggcatatatctaaaaaaattatcatatggatccaccaggggccacctaagagaatgttcagtgtggcctccttgtggcagtagagaattcagggcaaactagatatccattaagacgggaaaagaagagtaaaatgtggtggtaagtgccctctaagggatgctatgcagtgggtagatgaaatgaatttgatttaattttagttgtgtggatagatcataaaagaaatttgaagtgaaaaaaagagtgaggtttccagaacaaaaccaactatacttgaggcagcatgtcttattttaggagggtacacacatgtttatgaacagttcaaacatattagaggatcctggcattgacccatgaagataagatgctatgcacagaggggtaagatgaactcaactttccgcagctcaggtccaaccaaaccaaagcaaataagggagaggtgcagatcagttgcaataggcatgtggaggaaagtgtgaatatcctaattttagaagatcaaacaaattttcatgaaagtgttggaattccagctgctagaagagcaggattaggtggttgaagatgggaaaggtctatgaagtcagaggtaactgcttaagcaaagactctaaaagaagccagaagttaatcaggaaaggatgcaatgagcatggtagacagagattgggatgaagtgggtgagaaggccaagaagatggacaaaggctggggctggggaggcctggaaagttgcactaaagactattttgtagacaaggggcagccagtgaatgttttaaattgggaagatatatatatatatttaagaaagatattctgagagctgagttaaaggtggatggggagagaggtgactacagtcagatacatcttgtagaggaggaatcattaacatcagaatcacatggacacttattagaaatgcagattcctagagcctaattcagtccattgtatcagaagggatccagatagagccctggaatgtatatttttaaaccagcctccaggtggcacttagttcaactgggattaagaactatgtcattattaacctcagctgcatattattatagaatcagttgggaagacttttaaattcctgatacgggggctgctcatcagacaaactgcattgaaatctctgggcctggggcctgggcatcagtatttttttgaagctccttgattaattccaacatgcagccaaggttgagaaccactgcactgcaaagagcctttcttagaaaactcaagagccagcaagacttcccctcattctatcttcatttaatctccagctaatttgattctctacttaattagatcaaagcctcagggtctaaatcacttatattaaaaatataaattacccaatcttttatttgaagaaccccccagcacacagtatagtgcttttccatccctagtcttgggcaattgacatttgattatcataagaggtctaaagtcagaattaaataaaagtagcaagatccctgctctagtttcttctggtgaaaagaaacaataacaggtggtagaacagtccacatgccttgatattgagtataccctgaaatcatctacattcaaaatattggatgcatataccaattaaggtgaaaggaatgggtttgaaataaagtacaaactggatttgtaaccctgagtagcattaaggcatataaatcatgccttgaaattttattatttattagtcagtgaacagacttctgctttaaaatggtacctggctagagtttcctggggtattctcccagcttccctttaaaatttctaagaagaaaaagaaaagcaagaaaacttgaaagctcacaccacccaaaagaaagattatcaacccagtgccagaatctgggaagactttcccttaaatagaaattatatataatttatttttaatatatgtaatgtattttaacacccaactgacatcccctaatgaaatgtagttgatcttttaatatataagcaaatgtctatcaatatagattctaaaattaatactggatgctgaaactgataaacaggatagtttaaagatgataaatatttaggatgttgatttttaaaatatgtaacccaatagagagacatacaaaaaataactgaataattagagacactaagttcttaaacagaatattctgtgtatctactgaaagttatttgtaaattcaatgacttatctacagaagtcccaagagggtttttgttttgttttgtttttaaatatggcaaaatgatcctatcggttgaaagaataatcaaaggggcaatgccaagaaaatactgacaaggaagactttccctatcagactttaagatttatcaaagaattatagtaatcaaatagaagtagcacaggaatagaatcaatggaataggacagagtgtgtgtaaatatgaaaatttaacacatggttaaatgaggtatttcaaattatcagagaaaaagattgagctgggtttttttttgggaaaacaaaagtaagcactccttccatctttccactaagtagaactctggacaaatcaaggatttagatgctcaaacatgataaaatgtcttttaagcatgtcatgaaaaccagaaatcaaagaataaagaccaataaatctgattacctataagtcttagacttctgtatggaagaaagaagagaaaatactgccataaaccaatatctctgggcatcaggtaaggcactattctttagagactcaaatccatttgactgaagcccgattccagatcctttggtactcttcatcccttctccaagattactgtacacattcaggggctcacatgctcatggccactcctcacctttctcaaaaaatccttgttctaaattaatttataggttggttacttttctttgattttcctaaaatctcattcaaaatatttatttaacagagtttattgaaggtttagaatgtgaaaagaaatgccagcaatatcaaattgaatatcaggtagctttatcctaagaactcctttgtatagcccatttggaatatattattaacaatatttttctgcaggctttagtttcttgccatgttgtctatccctgtctctcacagtattttttttcacatcctctcatttctctactttttctaactctccacatttctatttgattattaaatgcagaaaaatagagaacacctggatcaagtaaaacagcaccattgacattttaggaaacacacacagacagacacacacacgcatgcacacacacactacatcttttcccatcacaaccactactccactgctagaaataaataatattctaagattgctagtaactacattcgtgtttttctttatagttttattacctaggtatacatccgtaaaccatgtaaattagtttctttttgaactttttattaatggaatattggatatgttctttttgtctcagttttcttccccagctcatgttgataagatttgtccatgctggaacatgtaattttaatgtattcatgttcgcagctgtatagttttcatattacaattattcatctattttactgttgatggctatttgcattgtttccagttaggggaaattataaacaatgcttcaatgtatatgactgtatatataccttaatataataactattatttatacacacatttttctgtgtccctacactaggcatttatagtccaatcagtgatttaggagaatttctgatattccacatcttcaaaaacatttggcatcagcaaacatctaagtgtgtttttattgatgttttaatttatatttatctgattactcattagattttaggaaattttcgtgtatttattgaccatttggatttcttcttttgtgaagtgtctgtctaaatctttagtctgttttttaaattggttgtctgcctttttctctcaatttgtaagttattcatatatatactcaatactaatcctttatcaattatatgtattgcaaaaatctcctacttttctcttattagtgtgtcttccatttaatgttttccagcctgcctatgagtttggctagccctttgcttcacagtttcctgatgaactgctccctcactctttatcatctaagtgactcctcaagatattctctgaagcaaaattaatttcccacttaaaatagtctcatggcatacattaaaataacaaaaaaaccttacccattatacaagattaaaagaaaaaaaaattttttaacttaattcatatgatagctactgtccatggtatacaaaaaaaaggttatataaaaccataagaaaaagtcagagacaacttaaaaatgggcaaaaaacatgaacaggcaaataataaaagaagaaataccaaaggtcaataaacatacaatatctgtttaatagcattaagcgaatataatataaatataatttgatataaacgttcatctatgacaaagcttgaccaaactctatacttatgatagtgtgaaaaagaagggctaccatgaacagttaatggaagtaatgcatttgaacttgctggaacactatttgacaatatgtataaaaaatcaatgtaatctttgaatctgaaatccatctttttacagtttaccttagggagatacctgcctagctgtgaaaagaaataagtagaaggctttcactgcagcattattaatagtaatgaagtgaagtgaaatgccccgcagcccccaaggctggtgactgtctccacaggactgcacttgcattttctaactagtgagtttcaaaataatgccacataggctggatattttgctggcccaacatatgtaattgatttttttaaatgtgaatttatcgcctttatttaaaaatcagtggattccactttaaaatcgggatttaggacttatctagaaaaatcagattcagtggctctgagccatttatattttctcataataacaatcagctagaattaaatataaactcccctacagtttgccattttcttatgtcaggcctagctaatacaccactttagtttatagtgcataggataataattcattacattctgccaaggaggcctgcaaaggatttgcattttcccaccttttaaaataactttattttcctaattataaaagtaaagcaagctcactgtggaaaagttgaaaacatgaaaatgcataaaaaaacaaataatagtaacatcatcccctcctaaaaacaacacttgtggaattggcatatatattctttcaattcctttgtccatgcatatatgccttgtataaagtagaaatcatgcttatattctgatattttctagcattatataaacaaggcattgcataattttcatttttaatgactacataacattccattatatggatgtaacataatttacacagcccttcttctaatgttgaacattggattaggttgtctctgttttatgtgatggggggattctttttgttttattgcagtaaatagtaaataatactggaatgaagatctcatactatagtttagaatttctatattacttggataagagatttctagaaatgaaatttcagaatgaaagtatatgagcatttttaagttcctttatatagagaggattgccaaattgttttccaaacttagttggatcaatgtatattctcacaataggaaaagagtccccttcctaaatgtatatgttttcccatagacataaatagtttagggccattttcaccattgtagtttctaaagcccatttaattctgctaattgggatgatgtattttctctctctctcttttttttttttttttttttttgagactgggtctcactctgttacccaggctagaatgcagtggcacaatcacagctcactgcagccttgacctcccaggctaaggtgatactcccagctcaccctcccgagtagctgacactacaggcatgcaccaccatgcccagctaatttttgtattttttagagagacagggttttaccgtgttggccaagctggtcttgaactcctggcctcaagtgatctgcccaccttggcctcccaaagttctgggattacaggcatgagccgagccaggccataattggggtgatttttcatatcgacaataacattacctttgtcagtgaggacataaacaaaccaaaagccagaccatcaaacaaacacaagcaggattggttcaaagagaccaatatcatttctcaggttagaccaacagtcactcatgaatgtaaaggtgaaaaatgaaaaggtacctgaaacactaaccctgacatcactgtccctgcaaatccttattgcacaaagacgagagggctatctcccaagaaaaagatgctgaagatttcccttccccttggctgcatcaaacagagtaaaaggtggttacaaaacaccccacttgtaaaggcggtcatttccagatgttgtagccccaggtaccaaggctccacaccagatgtgatccccagggattgagggggtgagagagcttggagcacacagctgcagatgatgaggtcatcagcacaatttggggaaaggatgagttcactcgggaaagggggaaaaaagcatgtcacttttcttttttcttgtttgaagtcactaagcttcagggttcaggagtgaattgttgctctgactttattctttggaggcgggtggctgcctgccagaggcagctgcacacaggtcatttgcattgcatgcagtctctggttttagagggaagctcttcctttccttagatcatctgcttctttagagtcagagccactgcctcacacagactgtattcgccctttaatcttttccctacccctccctttccctgacttactccgtgcagtttaacaagcttcccagacaggtccagcaggctcatcccaatagctttgaaagccagctggcggacaaaggaggaattatttcatatactcatggctgggtgggtgttggggagaggcaatttgtggaacacatggggtcccctcgcatctctctctctctctctcactctctctctctctccacccccacccccttctctctccccaagccatccaccccgaggtgccaatacctagatacttagtagcctgggtttcggctgggtctgaccttctgaagcacagttaagattgctaaacttccaactggctctggcaaacctggttgtgccatgagaaatcagtttctcagaaagaggagcaaattctcttttgtgtatgggcacattcttggagtttcaccaaggtgatgccgaggctaaaaggggtgtggatcaggctgtccaatgtggggaaacttgcttttagttaaatgaggcacctcttttttttggatggtgcaggaaaaatagaaaagaaacagaaggtagactaggtaggggacaaggatgtatggacctttttctacagagaaaaagttgtttctaaccagcctattgcttattaactaacaagaatgtttcaggtgtcattttattttattttttttctctctccagttagggatgatttcagccattactttagaaatgataccaaatggagagcaagtggtccatttcaacttcatctgtgaaactcaggcgggatagagtccagtctgagtctaggaaccaataaaaagaacaattagagaggtgtattagtcactgttgagcacctatgtgctgagacaggcactgtatattactaaacccaaagatgttcttcccatcctcagagagcctagcaatcaataaagcagagagcggcttaataatatcagatggactttgcttcttaaccattggcatctggggggtgtcctaattcttattactaatgttgctatgaggcatcttgagagtgttttaaatttttaatccttttagagtgggagaatctctattaactagaattcaaatagcaggattttcaatatttttcaattcactttgagaataaagaaaaaaggagaaaaaagtaacaataggttttttaaaataatgtttcaagagctatcacaatctcccaagcattctgatattctgatatctgggtttctttcttttttctttcttttttttttttttctgacagaatcttgctctgttgcccaagctggagtgcaatggcgtgatctcagctcactgcaacctctgcctcccaggttcaagtgattcacgtgcctcagcctcctgaggagctgggattacaggcacccaccattatgcctggctaattttttttttttttttttgtatttttatagagacagggtttcacgatgttggccaggctggtcttgaactcctgacctcaggtgatccgcccatctcggcctcccaaagtgctgggactacaggcgtgagacaccgcgaccagctgatatctggttttcataatgaatatagtcagatccttcaaataagaaacaaaaatacttttccttaccaaccatttatactagataccggttaacactgacacataccttattgtgtttaatcttcataataaccttaaaaatatagatattatctccattccacagagtagcctctggctccacacatttcaaatctggtttctcctccactgcccacatatttccagtgccaaacactgcgggacactttcatgtggagatattgggagtcaacttctggctctgcctctttctgtgtaccttgccaggtgggtcagtacactgagctgtaggcatggaccaagaaaccattcctatactgatggccagcagtaaagccagtaaagcagcatatggatgagactttgattctcacaaatttatcccgctaaacccacactaaatgtatctctaactcaactgccttggatcactccaactccgtgtaacggaaagggaaatcgaacagagggaaagtagaaatagagaaagcagtcaactcattgggcttaaaacaccctacttttataaattttgcaacaaaaatacaaacatggggacacattgctagcatccttcttgggggtctcaaaagaggcctagaagcttcagctttattagcttcatggtaaattggcctctgcccagggacgctgccattgtccaaagcatttggcattgacttcagagcttacttcatgcatgtctgaatagcctcattggtagctgtaagggttgattggatttttggaagcaaccaaagcttttggaccgtagtgttatggttcaggtaattggtcaagctgtggagtcctatttggaggtcacaagtgtggtagttttgttctgtagctcattatatttgagaacagttctctaaaacaggggttttaccctgcaaatcacaaaatacagcccaggattattccaaggtcctttaacaaagaagtggcagagtccagtttgcatctcccagtacccaaagtccagactgtaactcagccagttgtctgtctccttcaagtacacagagtgggacacagagctggaatgtctcttggctgcatgctccagacactggggatttgcttatcctcacagctaatagctatcatgagctctgtctttgggaaagggttttgttttgccccaaacttcatcccatggctttaatcccactgcatttgtcatcttcagcctcactgaatacagagaaagggaggcttcaaccagcttgccagggaggtaaataggtttaaacttcaccacagatggcctcatctcacggtgccagatttttatcaacaactggtgtggctactgacatggcaaaaaaccacagctagacctggctcctgtccacttctgtgataacagagaccaagaggggatagaagagacagtaacagctcgacaatttgagatagagaagggaaaagaaagaaagtgagagattgaggaagaaaagagagctgtcatgttacaacctggaagaggtgacttaatagaataggtatagaaatgaaagcatattgaatttgtctgatttacttatttaatgcctgcctcattccacaaagagtccttttatttttatttttaattagcccttttatttttaattagggttttatcaagatggaaacagttttttaaaaattctctgctttgagtttagagagaggagaaaagtaacatttttaaattgttcattatttcgaaatttcattccgtctccctgtgcagtcagctgccactttcccaccattttcaacttcttttcctcaaaaacgtggcaattagggtgagtatgtatttgtcattgctgtacagccacacatcagcagttgactggaagagtaagaaaaatagagagggaattgtagaaaaaaagaaagaaaaaaggaaaaacattacttggcctgtaatctttgggaagtcgccagaatctttttctagccagccaatcccatttcatggtgtgtgtgtgtgtgtgtgtgtgtgtgtgtgtgtgtgtgtgtgttcacactctaaacctgggtaagcatggaacactcagatgcccgcaaattgctgagatatatgaagcagaagaagtgctactagcagcagtcatggtccaagtgattatcaaagccctcctctcctgatcaggttttgtgcaaaacacgccagagaaagaaaggaaggactgaggactgcttgtttggcatttctttgtagtctgggccttttcttcccctgaggtgattgttgttgttaaccgaagttgtgtgaaactccttctgtgcaaaaactggagcttcctctttgaagccagagtgtctttgttcttcacctaacttggtgccattttcgacaggcgcatttgtgttgaagtctggttaatgcctgccacccagaattcagtgaggctgtttgccaggtgggaaaaagcagttatggcggggcctgaggggatagttgtgggtttcagggagtggagagatgggcaggagttgcctacaaatagaaagacaaaagaagacactgtaaaagttggctttgattggtggcttagagctcacagttctcctttgggatttaaatgctccagaaaagaatgttctgggacttggaagaagaggggagaaaggcaagtcggatatattgctggattacagaaaaagaaaaggagagaagggtagaagtttacaaaatgtaattataataaaacctcttaaaccctggctttgaaaccaggaatgggcttagtaggtattaacatagaaagcagtaatttccagggtttccccaaaacacttaattttactttttgaagtttatattcaaaattttaatttagcaaacactcaaatgtgttaaatactaaatttttaatgcattggagtaaagtagatttccatcccaccagagttagatttcaaggttggcaaatattgcttattagcaaaattggcttgaatatccttaaatcccccattaattaacacacatccctgaataataattcttatccacactaaagttggagaaccactgactaaaaggaaaaaaaaaaaaagactgggttagcatgtcatgattttctttaacagcttagttaccaaatctaagctgtgaacagggcaagagtggaaatctccagcatttctgcttggcaatggttttactcccctccctttcagcatgaagctcctattaccttaatatacatcatgatctttttgtggtggtggcaattaaactagataatgcagttcttcttatggcagggagttgccctgaaagttagcatgtgaatttgctcttaattcagctccacggtataccaaaacattaacttgttggctcagccctaccattaattagcaggtgaactcaggcaagccgcttaagctctcaggacttgcatgcatcagaggactagatgacttctaaattctctcccttactaacagtccatgctactaattcaaaacctcttcttggccagttgcagcggctcacacctataatcctagcacttcaagaggccaaggccaaagggtcgcttggggccaagagttcaagaccagcctgggaaacatagtgagagcctgtctcttaaaagaaaaaaaaaaagaagaagaaagaagaaagaagaagcagcagcagcagaagaagaaattagctgggtgtggtgacataaactggaagaaaaaatacatcccaacccaaactctgtggcagcggtacctttattgttcatccttgctgggttcgcctatggtatatgcatatcagcagacccataatgttgcatcccttcaaacaaatattctttgagtatttattcaacacgtatttagtgtagatgggtgaaactcttttcctagtaacaaaaactgttttcagaaacagagtcacattactctccttaactgaattatactcaatatattaatacaaaagaaaattcaacaaaatatattaaaaacacattcagagtttaaagataaaggactaaatatgttaaattcagatgtaatgaactcctaaaagccaaaaattattgcttatatattttgaactataaatgggtaaagtcattgaattgcattaactagagaaacacatatatagtaactgagaaataataaaaccttgtacagttgaattgctgaatgcctgctggaagaaaagtcagcaaaagaatccacagcattgccaccttcaaagtaacttactgaattaaaaatttagctggaaaaagagactgcgttgccacgtcttctgcataattttacttttgccttataaacagaagaatctacaagcatggctattttgcttgcatttgtccagtatcagaaccaactaatcatcaaagaagattattttttatgtgaatgcttgacaacacacacaagtggtgctaaaatattcaaagtgttgaatatttccttaatctattgacttatcctggaccaactttgctgatgtcgtactggtgttgcaaaagcaatgggaggtaaagctgctggcaccttggcataaatcatggcagtagcaccaaaccatgccagtagttactgtattctgcatcacgacatacttacaatgaaacaaataaaagcaaaaacttatttcacttaagaatacacttaataatgcaataaaaagtataactttttttttttttttttttgagacagagtctcgttctgtcacccaggctggaatgcagtggcataatcttggctcactgcaagctccgtctcccaggttcactccattctcctgcctcagcctcccgagtagcctggactacaggcgcgcaccaccacactcggctaattttttttctatttttagtacagacggggtttcaccatgttagccagaatggtctcgacctcttaacctcatgatccacctccctcgtcctcccaaagtgctgggattgcaggcgtgagccactgcacccagccaaaagtataattttttttaaacacgacccttcagttgaattgctgaatgcctgcaggatgaaaagtcagtaaaagaattcacagcattgccacgttcaaaataacttgttgaattcttaataaacacactttttaaaaaactgtatgagaaaatggggagtacacgcaaagcatttctccctattgaagcatgatgggttttttttcctggatgtcttgaagaaaagtatctgcatgattgaattgcaagctgaactactcaatcttttcatggaatgccatcttttatgtgaaagaatgacttacataaaaactaaggttaggccgggcgcaatggtttacacctgtaatctcagcactttgggaggccgaggcaggcggattacaaggtcaggagatcgagaccatcctggttaatacagtgaaacaccgtctctactaaaaatacaaaaaaaaattaaccagtcgtggtggcaggctcctgtagtcctagctactcaggaggctgaggcaggagattggtgtgaacccaggaggcagagcttgcagtgagccaagatcacaccactgcactccaggctgggtaacagagtgagactccatctaaaaaaaaaaaaaaaaaaaaaaaaacaaacaaaaaaacgtttacctcaggttattcagatttaggtatttagcagatattttctggaagatgaccgaagtgagactgacatgttaaagaaaacaactgacactatttgctatcagttatgaaagttaaactttcaagcacaagctagaattttggaaaactcatcaccatgaccatgacagcttctcagtgcttaaagcctcttctgatgaagtcgacaatgatattaatgaattatctgatttttattgttattatatttatactgtatttatatcatgacttcatgttttataatgaaatgcatctgtggttcactcggtgaaccaatgttttccaaatgactaatacctaatgttacaaaatcatgtctggttaataaatccattcagagtataagatagaccaataaatttttatgtgacagagtataaaaagtttattgattggttttagattccccattacaactaacttttaagaaactaccacttgtcaagttttggcatcatgtcaaagaatatacacaattatctgaaaagtctatattaaaataatctccccattttaactacataactgtgtcaggctggattttctacatgtagttaaatcaaaagagcatattacaggagagtgaatgcagaagcagatatgagaattcaacacctattaagccagacgtagagacttgcaaaaatgtaaaacaatggcactattctcatgaatttttttgtgaaagaaaaataacggtaagatgcagtaattttcccaaaaaaagttacattaatacataattggtttattattattatattattattattttgagatggtgtctcgctctgtcgcccaggctggagtgcagtggcacaatctcggctcactgcaacctctgcctcccaggttcaagtgattttcctgcctcagactcctgagtagctgggattacaggcttgcacccagctaatttttgtatttttagtagagacggggtttcaccatgttggtcatgctggtctcgaactcctgcctcatgatctgctcgcctcagcctcccaaagtgctgggattacaggcgtgagccacttcgcctggccgctttattacttttaattaataaatcttttttaaatttctgttttaagttctaacataacaaaaactgatgatatataaccctcataaaaaaaaaactaagttggggggggcggttacggatcttcataatattccaatgaataaagaagtcctaaggccaaagtatttgagaactgttgacttatgccattatgccattatacttactccatatttacccccctcacatgattaaactccttgagggtaaacactgaattttcattgaacctgtaaccatcttcagtacctagtatttagtaaatactgagtaacattcactgaaggaataaataggaatgaatgaatgaatctttcaactttagtacctgaaattttctttcattctataatgcagactttagtatctgaaattttcttgcattctgaaacagccaagaaaaattccagcaattacaatgaccaggttgtagagaaaaacataaaggaaagatcacaattctttcacatgccttttaagcttatctatggcttacccctgtagcctcacgaccactactccttgcctcatgcctcatgattcagcagcatcagactgctactaaatcacactcttgatctttgtccttagtactcagagttcattcactcacacactctatacaggtctaattctgaacctttaagattaaaattaggctaagaaatgaggcaactctattcactgtctcctgtaatactctatccatatctttttcattgcactgcaacaatttgtctataattatctttctatatctgtcttcctttctagactgtctcacacctttttgtatccttagtactatgcatagagtctgacacttaatgggtgctttaaatgttagactgaactgaaatgctttatatccatgatgttaaatctgaggtataagtcacccagggccattcaacttcattcactttcattgaacacttacatgtgttagccactacaatgggcactggggataacaaatatttatgtcagtgagcttatggtccagtgggggagagggggatctataaatggcagaaaataataaacaagctacatgcacaagtttctacagagtttgtgtttattttttactttaataattaaagaggagaagcacattccttcaatatttagaacacctatgtctagcaagacacttattcaagacacaaacagaacctctgccttcaatggacttaaagacttgtaaaggagacaggcattaaacaaatatcacacaagtaagtatgtaagtgtaaatggtcagcaagattgggaaggaaaaatagtgatacatcattatcagggaaggaaaagggatcagaaatggtaccccttaggaaatgtgtgcaggtgggtaggcacatgtgggtgttaaccacagggaaaatgctgagacgagcattccaagcaggttaacgtggctggggtagaagtcttcacaggaaagcaggcatttgccagctttaccaggcttgaaaactggagagagcaagggctagaggaatgggagaggggctcgcatagcacggcgaaggctgaagcagcccagagctaagcttaagtgcttcattttcctcttctgatatgcagaaccatgattccgggtggtctgtattcattgcacataagcctctaaagataaatggagactgtttcctcaagtaactactgctaagagaaaagttttcttcagatgtatttctccatcagtgcttttcccatagggcacctaaaaccttgatttatcataaatgtttcacccagcatacacatacagtaatacaaatgtggcatatttaaatgcacccctcagagaaatttgctggcagtgctcatgacccataaataaaggaaaaaatagcccagctatggttgtttccagaacgagtagatagacccccatctaggctactgcccagaagctgaaacataactcaagagagtcatgaccgtgttacgggaaaacccgttctggagctgggacctactcctccttaatggctgcctccagaaacaggaggaatattaacaaagctctgtagatttcttcagctggtttgttggacatggggagcaaggaagtggatctggccagtcagcaacgtggatctagttgagtaactaaggtgcagtgcctcagttcaaactacggctcaactgcttactagctctgtgatcccagttaacttatttaccttgtcactcatatgccctctctgtaaaatggagacataagtagtatctgtttcatagactgctgtgagcattaaatgtgatgatgtaactcaaggcttagcaaagcattcattaaatgttacctattactattatgattgctcacaccagtcaatcagccaagagcatttccaggtctcaaatcagtcaggcttcaagaccagcttaactgactgttttattcccatatgtaactacttgattagcatgttaaggacacagtttctgtaatgaatcaccctgtttttagtcttcttgcagataacattcattttatgaaattctagccaaacagccatgcaagaaaactacttggttttttatttcccttccttattgctcataacctctgtgtcctgtaaaaatattctaagaaacccctctctattaaaatctgaaacacagtgctaaacaagctctcttccccgaatttgccaactgcttcctttactactctgaacagacactgcagttttgagaatagcagttctctcatcctgtcactcaccaacacccccagactgggggctcttgaatccccattcagacctgagagctttcacaagtcctcatttaacatccagcaacgccttgaaaccaaacgccagccacactcaccctaagactgggtaaagcatgaagtaatcacagactttgatatttttccgaccacaaaccccctcaaagtcaaatgtgtccatgaaagaaaagtggctctttcttacctaatccacagtggaacaggaatcaatagaaaccacatcaagattgtgcttggtaaaaaataagaaagactttcaaaagtatacatttggtttaagtacgcctgaaatatgaaataactagaataacaccatccttcttgaccttgatcataaggcctttcataggtatctctcaatacctcaagtgaaagaaagtagttagaaccttgaaacactttttaaaacctgcagacagcttaattgaaggggtcttgtgaagagttcattgtcaggggtttctagcaagtgttatttcttcctgaattccacgaaccaagttctctgaagtttacattcacacaggatgaacaagcccactgtggtgggctttaaaagggataaaagacctgctgtggttttctttgggggacaggtttaacacccgcacctacacacccagacccagcacctggcaggatggcagagaagcaggtggcctcccagagttacagcttaaactaacatcacatacatttaaagcaagtgctggtaactagaaaagtaatttctgacagtaagcaaatggctcttaaataataaaataaaatgtgtcaggtggtagaaagcagtgacaaaagacaaacatttggctaaatagcatttaaagggagaagaaaagatggacaaaatcatcatgcagaaggcagaaggttttgtttttgtttttttttgagacagatctcgctctgtcgcccaggctggagtgtagtggcgcgatctcggctcactgcaagctccgcctcccgggttcacgccattctcctgcctcagcctcccgagtagctgggactacaggcgcccgccacaacgcccggcttttttttttttttttttttttttttttttttttttttctgtatttttagtagagacggggtttcaccgtattagccaggatggtctggatctcctgacctcatgatccactggcctcagcctcccatagtgctgggattacaggtgtgagccaccgcgcccggccacagaaggttcttgtgcacgtgaacggtgccaagggatggggcttgtaagcaaggagaggggagaggaagagaaatttgacatgtgattatcatcacaatcccactgctgttgctgcccgcttcaggtctaccttagtctgaacagtcaatataaaccttttggatctagactgtgttccggaataggcagaactttaggttttagaaggacaagactgcctttggcattagaaagaagaggaaaaaagatctttttattattgccattaaacatatatcagataaacagctgctggagctaatggcaaaaaaaaaagagacaaagtttgaataagcatttgctatcctgattggtgttagcactagtctttcctatcttctggaaaatatctgtttgtttttgtaattataaaaataatacatgctggccgggcgcggtggctcacacctgtaatcctagcactttgagaggccaaggcaggtgaatcacctgaggtcaggagttcaagaccagcctgatcaacatgaagaaaagccatctctactaaaaatacaaaattagctgggtatggtggcacatgcctgtaatcccagctactagggcggctgaggcaggagaattgcttgaacccaggaggcagaggttgccgtgagctgagatcacaccattgcactccagcctgggcaagaagagcgagactccatctcaaaaaagaataataacaataataatacatgttaattgcaaaacttagagacttggagtattgaaatcagctagacatgtatgtaaatctatagtaattgtactaaatatggttgcaaaaacaaaaactgtcaaacattattcttaaaagattagaaataaggtgtaaaataataattttagcaacaataacaagaatctagaactaaacccccaatttatattttcaaaaattgttaacgaggaaagggaacataaaaaattataaggctattaaactatatgtcttaaataaggagtctcaaaatatttgtgtttgtgtttgttttttactttaataattaaagaggtattggtcaaagaacaattttttacttaaaaagaaataaaattaagatagaaaatgaactttctagagcactatagaagataaaagccaataaattatagtttatatgtgtgggggagggactggaaataacaaggaaacctaaagaaaataattaatatatcagaaataaaatcaaatatcaataaatgggttgaacttccctattacaaaagaattcaaaataaattttaaacattcagtgattgtctatgacaagtgataaaaagacacaaaaatattaaatgcatcttcccaaaatagatatcaaaatattaatatcagtaaaaaggaaaattcaagacaataggcacaagacaaaaagtataatttcacaataagtggttcaatttataacaaagatgtgagttaagaaattttatataccaaaaactacctgcttccaaatatacaaaggaaaaaaaaatttaaaatccgagatgaaagtgacagaaataaaataggattggggccaggcatgatggcttgtgcctgtaatcccagcactttgggaagccaaagcggacagatcacttgaggtcaggagtttgagaccagcctggccaacatggtaaaaccccatctctactaaaaatacaaaaattagcagggcgtggtggcactcacctgtaatcccagctactcgggaggcatatgtccatctatactatgtatatatattatagaattggtaaataaaccagaaccctctctgttttagaaagatcaataacgccagggataaataaggaaataagagagctgaaagataacaataagtatgagtgatttactaactatctatagatgtatctctgaaacattgtagcctatgtataatatttttggttcccatgaaacaataacaaaacaagtatgtatataaaatatgtgtaaatatacatatttataaaaatatatatgtatactgaaatacaaatgttttcaaaaaacagaaattttatcaatctcattgaccacaccgtttaaaaaattaatatcctcagcaattcaatgcaggaacagaaaaccaaatacaacatgttctcacttataagtgggagttgaaaatgtgaacacatagacacagggacgggaacaacacatgctgaggcctgacggagggtgtgtgtgggtggggagggagagcatcaggaaaaatagctaatgcatactgggcttaatatgtaggtgatgggttgataagtgcagcaaatcaccatggcacacatttacctatgtagcaaacccttacatcctgtacttgtatcccagaactgaaaataaagtcaaaagaaaataaattccacccatttggaagttttaaaacactcctttaagcaacttttcatttaaagaaaaagtaaaaactggatttatacattatttagaaagcaaataactatcacaacctataggatgaagtcaaattacatcagacaaaaatttatattcttaaatgttttcattattaagcaagaaaaacaaaatataataaacattaagtttaagaagccagaaaagaaacaaaaatttttaagaaaaactgatacaagggattaatgaggataacataaaagatttacaagcctaaaaggtaaaatcaataaaaatgtatattcacacataaaataatacttttgaaagttattacaatttaccaaccttctctgcttaatctgaaaaagaaaataaatatttggaagagaagatatagataaccacagccatggagctttttaaattgaataatactctgtacaattttgtgttaatataataataaagtgaacaatattctcaaaaaaatagatattaccacaatttgctcaggaacttaaaaacttatgtaaactaataactagaaaataattgggaaaagttgccaaaaatggtaataatatttgtagtgcctactatgtgttctgctttatactaggtgctttatctattatccctgacatacaacattgtaagataggtattatgatctatatcattgtatctccatttcaccctgtgtttcccttattacatgcccatgtaagcggcatcatgcagtatttgtttttctgtgactgacttatttcgcttgtcataatgtcttcaatgtccatccatattgtcgtgagtggcagaattttcttttttaagagttaaaaatatttccttgtaggtatataccacaatttattaatttatctgtcaatgaacatttaaggtgtttccacaccttgactactatgaatagtgcttcaatgaacatagtcaaattcacagaatcaaagagtggcatcgtgaggcgataggaaggtggggagctactactcagtaggcataaagtttcagtctagcaaaatgaataagctgtgaagatctgctgtactatattgcacctatagtcaacaatgttttgtgcacttaaaatttgttggccagacacagtggctcacacctgtagtcccagcactttgggaggccaaggcaggcggatcacaaggtcagtagataagaccatcctggctaacacagtgaaaccccatctctgctaaacaatacaaaaaaaattagctgggcattgtggtgggcccctgtagtcccagctactcgggaggctgaggcaggagaatggcgtggacccaggaggcacagcttgcagtgagccgagatcatgccactgcactccagcctgggtgacagagtgagactctgtctcaaaaaaataaaaaataaaaaaaaaaattgttaaaagggtaaatctcatgttaagtattcttatcacaataaaatgataataagtttgttacattctgctgttatcatttgtcttccctactaaattccaagcactacaagtacagggactgtgttcaccataagcatcctcatattcctagaactgacattcacataaagcttctcacataaatgtaactcaataaacaactgattgaagcaatgagaacactgggagtaaccatagtataatataacatagaaaaattaccgtacagtctcacttatttatatagatacaaaaatcctatctaatgcaaatatccctgtacatctaattctacctaatgcatatatctgtacattcattcaggctgctataacaaaataccatagactagatggcctataaacaacaaaaatttatttttcacagttctcaaggctgggaagtccaagatcaaggcgttggcagatgtagtgtctggtgagagtcagttgcctggttcatagatggtgccttctcactgtgtcctcacatggtggaaggggatagctagctctcttgggtctcttttataaggactctactcccaatcatgaaagctctgtctgcctcaccgaatcacacgccaaaggtctcacattcaaataccatcaccctggaggttagaatttcaacgtatgaattttgtgggggacaaaaacattcagaccatagcactaagaaacctcatattatcgagaactatgttataaaacaattctttcaatgggtagaatgagaagactcacaagaacaaagttaccttcctgaaaaaaaagtttaataatttttaatagaaaaaaaaagtctagctatagcaaacaaataccctgaacaaatgtagcatttgattatggtatgtgctcaagtaaagccttttcctgtgtcttccagcactgtcactagcccaggacttcttatatacacttaccaatgttatcgcctttgccagaccacttttccttttttcttgtactatttctatcagtaagctgatgacttcagctgtcacccttgtagtacaaggccatggcttttgtctgccagcacctcctctgaccctttttggtaacagatccacccctgaggtagagaacccatgatgcaggctgggcctgtgagattactcctggctccagccactatgtttggtccaaggagtgagcactaagtgaaaataagtgagtccaccacccagagagaaagcatgcaagcgtctcatgctagttcccaatcctgaggtcttactgtacagccattaattcaagtctgtgatgttcccaatagcctctcaatgaatccttttactgttgttcaaatcagcctgggtctccttctgttacttacagcaggggaaacccattaattaatagatctactattttgtgataaatcataaagccattcaaaccaaataagagggtttttttctccttctctatttcccttgcaatattagctcctgatatcaacggtgccttgggctgtcagtctaatgcaaaatacgtttcctaaataatgcaccacgttgtatcccgtttgcctcaggaaaatgtgtgctgcattagagaaataccagcagtagatgaaaaggatgacctgtcagagattaaacttaattttggtttatttctctgtctcctcttccaaatgacagtgagaggacatacatattctcccttggaaaatgaatttcttctaaagcagaaaatggttggagggagctaggaaataggcatatttaagatacttgtgttatacaaatctaggaccccattaggtaataaagctcttactgtctttatcagagaggagataattgttagatgtttctgttaaagtgtcaaaataaaaaggagtatgataggtgatctgggggctttcaaaagacaattctggtctcaatcatgggttctgaccctcttttattatcactcctggggcagtgatgatatccagtgtctcatttttggtaggttaaatggacagatactatcactctgttctttgttagtatcaatgaacagaaagctatctcaatttttgaacaaatgcttctcaatgaatgtttttaagcattacatgtctcatttgttgtaaaaaatatttctgggaaaagtatacaaatatttcagtgtgccttagttgagattaatagttaatagtcacgattggttgtttccatctttttcccaaggcagagagagaaaaaatataattaaatgtgtcttaaacttatggagggttcaggcatataaggggaatttggagaaggtttgtcccaaaagactcttaaaagctggttagaactgaatcaaatgtatacatttgctcaccaaaagtcaagaagaaaaatgttcatgatacccccaaacagaaacaatgcaatgcccatcaccaatagaatgaataaatggattgtggtatagtcacacagtggaataccgtacaacaataagaatgaaaaatctgtacctacactcaacatatgtcatactcataaatataatgtggggtaaaagaagccagacatagaaattgccaactgtatgattccatatatataaaatttaaaaccaggcaaaactgatctatgctgttaggattcagcttagcagttacctttgcaggggatgagtagtgatcagaaagaggttacaaggagggtagtggcacttctggtgtccaggtgatgttcatcatcttaatgcaggtactggctacactgatgtgttccctttgtataattgatcagtctggaaacctatcatttgtgctcttctctgcatgtatgcagcactttattgtaagtttttttaattgacaggaggaataatgaagaacaagctggtgctgggagcaggttagtcttcctaaaaaaagcttgggggtcccaacctttcttattttatggcacacacaggccatgataaaatttgaacacatcggggggtaaacaaagaggttggttaaagcctgaaactgcactagagactccatttgttgtaacagcgctacccaagtctctcactatactactgctttccagattgctttttcctggagaatatctgtttcaaattattgtacccatgtgttttggcttcctttacttcaatttgagtcacatctggctatcttctgcctatattcctgatcccagtttgcttttgtattgcttttctatcttcactggagctttcaacatctttcacttttgcatcctccaagcatttcattaaaccagttatatgcgttttccaatgaactcaaagaaaacagtcaactagtcattagaaaccccagcttcatttctggctttaagcaagttatttgccttctttgggtatgatctgtggattggggtaaccattttcttagcttccacagaggagtgcctgcagaaaggtaaagacatacacatatgttgagccttgagcttccaaaaggtataaaagaggaaattcattctgaactaggaaggcactgcaggctaccatcatcagaacttagatctcgagattcatccacttatttgctcctgttggttgttacatcaaaatattcatgggttctgtccctcacatttgtctatccagtcatttgggtctttgatttgacctctgtaaaagaacccttgctatgttactggtctataattagacttttctgttctagcctacaatcctttggatttctagtgctccatccaaccagtctggctccataaaacactttcaccaccaccacaacccacacacacgtgtgtctgcttgtgtcggaatgtgtgtccttgtgttgggagcactaaaacccaccctggaagagtctctactctatatctagaatgttcttaagtgaggggtttctaaacttgaattttatgaatgagaaatttataacagggtaattgttgtaagattgttccttggagtgctaatgtcctgtgaagttctagttctgatgttgaatatggtagtcatttattcaagttcatacaggactgagccaaagaagggtgcccatatcttttaatgcctagttatgttagttttctctgctatgtaacaaatcaccacaaatttagcagcttcaatcacacatgtatttcttatctcagtttctataggtcagaagaccaggccaagcttagctggattctccactaccgagtctcatcaggctgcaatccaggtgtctgcgaggaatgcagcctcattagaggctcagagtcattgggaacccaagcagaatgattttgtgtatgcagcaatcctattgatgaagtgctgagggcttaattcactttaacaaaatcagagagtcagaggattgagaaaggacaagaattagggaaatatatgatctctgtcattgtatgtgagggtgagagaaataggaaaggaagtaaatgtacaatcccctatttttgagttactcaatggagttgggtggccctcagtcttcccattagtggatggtttcagagagagacactgttaacacatgtggcagaggctgtggagaaggctgtgtatacttgctagtgagatgagctgagggaggactcactcctaccagcaggcagatgctgacagtataacacaggcttccattgagatgtgggaagtgcactggaagtctgcagcacagagatctgttcccaatgccagtgctggagttggacactgactttagaagaaagcaaagagtgagaccttctgagtaaatcacctagggctgaattgtacttctacagccactttggtattgcttcctcaagactaagccaatcttggagattataataaaatgtcctcggttgaatggacccattctgtgccaagtttctcctaactggcaggttgcgcttatgttaagctattcttaatagtgccttcgttggtagattattaaactttaggtgaatcaacagtagctcttcctcaggaagatcaatgaccgttggcacaggataattaactcagaacacttgtatttcctgttctgcatctgtgtggcctttggacggtagcacatttggcagggcatatgaagaaatattgagagtccaagactgaaaatttactagacttgctcttgggtccagctgtaccacaattagccttgtgatatttgtttgtcaataaacaatttcataatttctttccatctcaactgtaaaattagtattcatattaagagtgattaagtgctcttcatatatccagcactatactatacacaattcgagctttggagagtctatcctacctaccatacagggttgaaaatatctaatgaggtggcttctatgctttgagaaagtgtaacatgctatataagtgtaatttattattccttttactgaagaaatagttcagtattatttactaaagaataattccttttacatgctgattcctatagttaattttttttttctcctcataacatgatggcttccaagtatttctcactgatttcccatcccaaggaaatgtctggttgtttaggtcaatgactgcaacctataacattgtcacatagagaaatggaagtcattctttccttctttgtcattctatcttcccagactctgactactttcggccctcattaaaagggcttggtggaaaagtaatacctttgtttcatcaccacctcggatgcacccccgtgctgactccaaacagctcatgttcactaaaattgagctttcctcttattctcacatattcaatcagagctccatatgggtaagcaggagatcccagatggcctgaccacttcctggatcagaaagcttctcagtatataaaatagaaatctctttgatgatccatgtatttgtcaggatttgttacacaacacatgtcccagggaagtctcctgtgatttccagcacctctatcataaacccagaaaggcagttggttggtttgtttgtttatttagctttcacttgggcagttggttgcagagtttcctatttctttttcttctgcatgtctcatctcctaacttagaacgctgtcacgatggccttacttttaaaagcacgtgaatgctaagatccaggatggagtgctgattctctacagttcttctttgagatatatttctcatcatttttcagagttccccaaccctcacctacctaaacgaaaaatatcaagtctaaagaactttcacctctaaaggaaatgaccaatactcaattaacctaagcaaaatttattcttctttcttaaaacatatgtattcctttacaaaaatgtgctgaattctttctatgtgtgacactgttctaggtgcttaacctacagagtttacaaaataggcaaaaaattctgattcttctaagcattcttatccttatcaccagagcttatagagtggtgaggaagagagacagtgaacataatcagaagcagaatcagaagaagaagaaaacattttttaaagatatcatgctaattgcgataagtgccatggagaagataagagtgacatggagtgtcagggtggggggtgcaatttgaaattgtaaacactaataatagactgtgggagacaagtgtagaagcagaaagctaatcgtggcttaggatacagtgatagcagtaagagtgatgagaagtggccattttctgggcttatttttaagttagaaccaacagaaatgttggtaagttgaatttgagaaaaagaaaagaaagttaccatgaaagaaactaatttaggtgaaaaaataaaacaaacaaacaagacttgttttgaatgatgaggacagaggagttgtcagatgttaagaggagaaggtatgacataataagttaatggtgaaaagggaaggagaaaagaaagatttaaaaccatactaaatggtagttatctaaaattgaaaaaatgtaagttctcagatcggaagtgcatcctcaagtcttgaacaaaatatataaaaataaatccacaactagatacactgtaacaaaccggcagaacatcaaagaaaatggaagatgtttaaagctctcagagagcagacttttccttaactacagtcagtgccaaaaataacagaataatatcttcagtgctgacaggaagtaactgtcaacctgcaatttcatgtccagtctttcaactgtattgacaaaataaaggtattttctacccagcaaagactttgagtatttattgcccacagacactcaggaaggaaattattaagatttacctcaattagaagaaaagtgaacccagaaaaaagaaatgaaacagtgagaacagaaaataaataaaaataattaagtattttgaatttttgaagatacaacaaaagctctaaacaaaaagctgggagtgggggcattgctcattggtagtaaaagtaggctaagatcttgttatatctggcaagaaaatataaatattaaataacgaaataatggtagaaaatgtatggttaaatattttgttaaacatgtaagagtgacaactaaaataatgggaaaataatctagcttatgaaacaggaggaaggagaaaagaatgtagaaactgtattggtgtaccagaagaaagggagtcaaaaaaaaataagcaagaaaaaagaagaccaatagaaaacctaaaatgaaaggatagaaataaactcaaatacagcagaaaacaatcaacgtaagtatttaagcttacctaataaaaagcaaagtttagtattgacagtgttttgtaggcaattaaaactagattttgttttggtatcccatctggtaatttctgttttagagaataaaagacaaggcaaatatccaactaattttatatcaatgtttgtatcacattgattcaaaactagacaaactgttaaaagaaaaggatatatttacaaacagacgcaaaatcttaaataaagtactagcaaatgatctggcagagtgtaaaaaccaaacgaggtttatctcaggaatataagaatagttcaatagaagaaaatctatgccataccccttaagtacagattaaaggagattagtatataattattttagtagatgcaaaaaatgatgaaatgtgatatttgtcaagatttttaaaaaatcgctgccaactagaattataaatgataagggaacttccttaacaccgtaaaactacagcaagcattatcttaataaagcatttcacctgctgtgacagcttcgctttaatacggtaatgaagtcctaacttattaaataagaagaaaaaaaagcagcattaaacttggaaaggcacaagcaaacctctacttatttgtagatgatatgattatctaggaaataaaaaagagtctatacaaagttaaaatcaaaaagaaagtttaaggtttatacaaaaatcagtagtgttcctactgattgtggattagcaataaccacatggaaatgtaatagacaaaaaaagatgccactctaaacatcaataaaatgtaaaagacacctggggtaaatctaagaaaagatatactataactttatggaagaagctttaaaacagcattgaagtacatagaaaaacaccttaataaatgaacataaataccacattcattgatggaaagatccaatatcataaagatatcatcttttcaaattgatatataaattcattttcaataaaagccgggctcacacctctaatctcaacactttgggaggccaaggtgggaggatcaattgaggccagtagttcaagaccatcctggtcaacacagcaacaacaacagaaaaatcccaactgaaatttccatgtaatttaaaaagctgatcctaaaatgtttgtggaagaaaactgagaagaagatcttgaagaacaaaatgaatagtttggtgctatcaaatataatttatcataaagcttagcaataaaagagtaagctattggtgcaggtgaatagacaaatacatcaatggactaggatagaaagacctaaaaacaggccagtgtacatgggaaaaatggatatatagtggatgtggcttacaaattggtaaggataagacagatgattatttaataaatggtgctagaataattggttatttaggtggaaaacaaaacaaaattatgtacctgtattagtctgttttcacactgctataaagagctacctgagacagtaatttataaagaaaagaagcttaacggatttacagttctgcatggctgaggaggcctcaggaaacttacaatcatggtggaaggcgaaagggaagcaagtaccttcttcacgtggaaacaggagagaaaaagtgagagagtgaggaatgaactgacaaacactttaaaccatcagatctcatgagaactcactcactataacaaaaacagcatgaggaaactgccctcatgatccaatcacctccaaccaggtccctcccttgacacatggggattacaattcaagatgagatttgggtggggacacagagccaaacaataccttttctataccaagaaaacctcagagatgaataaagctctaaatatgacaaataagaatttaaaatgtttagaagaaaataaggtagaatgtctttatgtcttcaagctagataaggatttcttatctagttgcgaaaaggaaatctcactgagccacaaacacgatgagttgcccaatttgaatactatcagagaaattcaatttacaacagtaataacacatccaatcataaccataagtttggcaaaaattaaagcctgaaaacactgacaagtattgacatggaagtcataaaaccagagctctcatacaatactggcagaaaaaatagattgattaaactgctttaggagccatttggttatatctgctattgtagaagttcatagtctagcaagttgccttcaaggtaaatcctagaatagtgtttttaaaactgcaggttaacagataatgcaatcaatttagggggaaagggagaagagaagaggggaggggaggaaaaggcagagaagaagagggagggagggatggagggagggaagaggaaaaaataccagaatgcatcaccagttggaaggtgtagtccatgctgttggggccctgcccagatcattttcgtggggctaatggattcacccctaactgctgtattagctgctaactgctcacagctgccctcatttccacagcttgcccttggctgatgggagctacttcaactagaaatgtctgggagcttgcactcttctcttgaccccaccaagcagccaatgactacaaataagaggtatgaaagtcaggggccccctcctccacaatttcctgagggatcaagctgaggcaagacctcagaggaaaccacatctttgcttagctctttcctctattctgtcctgctcctctttcttccttacaggttttccctagcacaagaaagtctgtctcaggctttgctgctagggaacctgacctaagaaagaagggtacatatttttaagtgcttgtgtatgtatattgagttataatgtaaaatgtatttttagaaatttgaatgcttctgctctagggagaatctttcaaacttacacaaggaaacatgtataacaatgcacattgttgtggcaaaaattcggcaacagtctaaatgtctatcagtaggagcatggataaatgggtatggaaacaataaatcctactctcataactacttttggggaggaggaagggaatgaaagtcaaaggggatatgcaggaattttcacttgtatctaaaatattgtctttataatttttctaagaaatgtgaaaaaattcaactttattaaagctcggaagtgagtgggtacattaatgtttgtgatatcttctatactatatatattatatatatatataatttcatttaaagaaagcaagatgtgagagctctaaatcctcactcaaacccattctacttatctccctgatgcactcctgtggaatacacatacatgaggaagtcatttgtttcctcctttttgacaataaaaaatatgtaagttgtatttcctttcattgatctttattccaaagatagtcatgggagaactgttagatgttaataataataaaccatatgggtctttatggttagcttgtgctctcaatggccatgggtctgaggatattgtttcccagcatttgttcctcttgtttactctcccaaatcctttagaaagtgagaaacatagtatgtacatacataggaaggagagaagaagggaggaagagagagagggaagaatgaacaaaaggaaagtgaaagtgaaggaaggaggaaacgggatcatacagtttgtcaatgaaaaccctgaaactgtggagatggttgctcctttcagttcctaaggatgaatcagaatcaaccacattggagaaagttccagcagccaattatattctagctgtgggttgtttctttttttctatttgttttatgaatatgcaaggaaattgaggaaaagatagtcttcttccatctcccattgcagctccacacaccatagtgccataagaaaaggcttcccatttttctgtcaaaagcatccaaaaaccatgtattttcttccagctcattttggcttaaggtgaagcatatgggaaatttgcagatcaagtccatcagccagacatcagtcggtaatgatttgtggccatgtacgtataaagagaccatagttgtccattaactgcatacatatggcatctgggaatgtaaactcacagcctttaccttcaaaaccacatgctaaccagggaggtaaaaccgtggttcacaacatgtgggttgtgaccctgagtagtctgccaacatttggcaggtgggcggccagagatgaattgtgtgcctactgcaatttcctttctttggggctcccttgggtgtatgtgtgcacatattctcttggctataatatagacctgacatgaagctggagcaatacctgatgaagacctgaaacaatacacattcatattcctgtctcgtcatctagtgggcacattcttccatctgtctttattttaaatacattacatatatatgtttacatattgcatgggcctctgcaacttgtgtaatctctatcaatcatgagtgtgtattacaacccctacggggaaacctgactgtttgcaaatagagatacatccagccagcgaagtaggctctgactatcattagggaaataatttaggactaaagtatttgttctgatttgtgctaacagggaggaacctaatggtaagaacaaacttgaatagctgtcttccttgtccgtcccaaatcctttctaagggattaattgcattgttcattctctaaatccaaacactggtggtaactttatctcagcgttagtaacaaatcccttttagactgtttatgctctcgttggctctgaatggccttgacaggttgcctttttgaaaatggtcagattttcctaactgccatgacacacagactcaattgttttaaaatatgaatacgatatgttgactctgctgctggagtcaatgaaatattttaactatggtttgccaatgaaaatctttgatttgtttatggtttctttggtatgtgatggtgtgtaacctcacttttcttcagagccatgatcctgtactaacttggcaagtggtccacacttacttgcatcatctttgtggtgttttaatacccaactggcctcaagaatatttaatgatagctcaaccatgtgaggtgaaggtctcatggagaactaaaagcataatcacacaatttctaaagaaaaggcttacacattttctgaagaaaaggctcacacatttctaaaaaaaaaaaaaaaaaaggctaagcagaatgaagatgactggagctgtgaggcaactacatttctgtaatgtactattaatataacaaaaatagtgtctcttctgcccttctatgccctgctatcagcgtggccttggggtatttcagaacagtctaggcagccaactatgttcaatagccacctgagctcaggcttaaagactgaatctctaatgttattgcctaaagttttcccatgtctattgggataattgccaccaacaaggtcacatacacacacatctcccaacaactaccagtaatattcagagactgggtagtctgaaatacatattttcttcccaaaggaaatgtagtcacagaaattctgctctatccacaataaaaacaacctgtttcagtttagcttcttggaggccaagtctggactctcttccctccagaatagaatcttcattttctctttgcaaaatcaaaggcccattgaggtcattcttccattaaaaacaggttctatttttccgcaaatcctcaccccttataacacaaacactagaatgtcagaaactgaaaaaatccttcacttgcatattcccagtttactaaatttcaaatattatttttatagagcttttttgtcacaggatttgagaatggaatttggaaatgctttgacctaaatttcctcttagtagaagagactctagacagtggtttccaagaatcagggctcaaggtcaaagtccttgaacttccttttcttctgcttttcaaaacacaagctctgttccagctctcactcaaaagtacagagcgctctgagttgggggtcacagactgtcagctcccagttgcactcacatacacacccagagaaggaacactgatgatggagcatgaattcccaagtaagagagctggcaccccaaattgtcttttaaaaaaaaatccaagcgcaacaaatatgaagatggaaaatggggaggtgaaggtgactccaagtggaagggagtagactggcttgctgtagggtgggtgcattggagtgagtttcttcagaagttctctgctattgccctaagagagaagaagggtgaacgccccattgtctctgatccaggaagaggtcaagtcctagaagaaaagcaaagattgtgatgacccttaggagggtataaccagtgtggcacccagtatccagcctgtgccttcctaatccatgtgtagctcaaagtatgtggaaaaggaaggagagagaaaagcagaagaggccggagctcccagctgaggaaggagagctaaggctgttcactctgtagaaggggcacagacactggtaaatggagggtgaagcatggtggtggctggaggatgcagattcttctaggagtcctaaaggccaccaagaagggtcaatcatccctggcaataaaggcctctgggggaggaaagggacttagtgatgctgcagaggctgggagctgggtgtgaggtgtgacataactgtgttatttctcttttgctgccttgtaacccccagagtgctgattcctgaggggagtacatacaatccattttctaattccacttgttttttccattcatcacagctcatcactttcctacagcctgatggagagctcatttcctcctgagaagcagtgtagctcagtgaagacaggttatggagtctgatgcccaaggttcaaatccaggctctgttacttaataacagtgtgaccttgatcaagtgctttgacctgttgtgctctggtgttcttctctatataaggaaagtatggtatgaatatctacctcatcagtttttgaagaaggagtgaataggctaatatatataaagaacttacaacagtgcctggtctgtgttaaacacccagtagacagtgtgtacaagcttttacttgttaaaattagagactcttgagtaaaaagagcctcataaaagactatttcatttatacaacagagtgacaatgtgccagacactaagcaagggcctggggatacaaaaagtaacattactcagtccatacatttgtcaacttttcctttgagcttcccagtctcgggtcccttatcacaggctctcattatactattacttttgcatcaaagcatttatcacagtatattcatttatattttgtgtgattatttttctatttctttttttttaattttattattattatactttaagttttagggtacctgtgcacaacgtgcaggtttgttacatacgtgtacatgtgtcatgttggtatgctgcacccattaactcgtcatttagcattaggtatatgtcctaatgccatccctcccccctcccccaaccccacaacagtccctggtgtgtgatgttccccttcctgtgtccatgtgttctcattgttcaattcgcacctatgagtgagaacatgtggtgtttggttttttgtccttgtgatagtttgctgggaatgatggtttccagtttcatccatgtccctacaaaggacatgaactcatcattttttatggctgcatagtattccatggtgtatatgtgccacattttcttaatccagtctattgttgttggacatttaggctagttccaagtccttcctagggtgaatagtgccactataaacatacgtgtgcatgtgtctttatagcaccatgttttataatcctttgggtatatacccagtaatgggatggctgggtcaaatggtatttctagttctagatccctgaggaatcgtcacactgatttccacaatggttgaactagtttacagtcccaccaacagtgtaaaagtgttcctatttctccacatcctctccagcacctgtggtttcctgactttttaatgattgccattctgactggtgtgacatggtatctcattgtggttttgatttgcatttctctgatggccagtgatgatgaccattttttcatgtgtcttttggctgcataaatgtcttcttttgagtagtgtctgttcatatccttcacccaattttgatggggttgtttgtttttttcttgtaaatttgtttgagttcattgtagattctggatattagccctttgtcagacgagtagattgcaaaaattttctctcattctgtaggttgcctgttcactctgatagtagtttcttttgctgtgcagaagctctttagtttaatgagatcccatttgtcaattttggcttttgttgccattgcttttggtgttttagacatgaagtccttgcccatgcctatgtcctgaatggtaatgcctaggttttcttctagggtttttatggttttaggtctaacatgtaagtctttaatccatcttcaattaatttttgcataacgtgtaaggaagtgatccagtctcagctttctacatatggctagccagttttcccagcaccatttattaaatagggaatcctttccccattgcttgtttttgtcaggtttgtcaaagatcagatagttgtagatatgccgcattatttctgagggctctgttctgttccattggtctatatctctgttttggtaccagtaccatgttgttttggttactgtagccttgtagtatactttgaagtcaggtagcgtgatgcctccagctttgttcttttggcttaagattgactgggcgatgcgggctcttttttggtcccatatgaactttaaggtagttttttccaattctgtgaagaaagtcgttggtagcttgatggggatggcactgaatctataaattatcttgggcagtatggccattttcatgatattgattcttcctacccatgagcatggaatgttcttccatttgtttgtaacctcttttatttcattgagcagtggtttgtagttctccttgaagaggtccttcacatcccttttaagttggattcctaggtattttattctctttgaagcaattgtgaatgggagtttactcatgatttggctctctgtttgtctgttactggtatataagaatgcttgtgatttgtgcacactgattttgtatcctgagactttgctgaagttgcttatcagcttgaggagattttggactgagacgatggggttttctagatataaaatcatgtcatctgcaaacagggacaatttgacttcctcttttcctaattgaataccctttatttcttactcctgcctgattgccctggccagaacttccaaaactatgttgaacaggagtggtgagagagggcatccctgtcttgtgcccgttttcataggtaatgcttccagtttttgcccattcagtatgatattggctgtgggtttgtcatagatagctcttattattttgagatatgtcccatcaatatctaatttattgagagtttttagcatgaacggttgttgaattttgtccagggccttttctgcatctattgagataatcatgtggtttttgtctttggttctgtttatatgctggattacatttattgatttgcatatgttgaaccagccttgcatcccagggatgaagcccacttgatcatggtggataagctttttgatgtgctgctggatttggttttccagtattttattgaggatttttgcatcaatgttcatcaaggatattggtctaaaattctcttttttggttgtgtctctgccaggctttggtatcaggatgatgctggcctcataaaatgagttagggaggattccttctttttctattgattggaatagtttcagaaggaatgataccagctcctctttgtacctctggtagaattcggctgtgaatccatctggtcctggagtttttttggttggtaagctattgattattgcctcaatttcagatcctgttattggtctattcagaaattcaacttcttcctggtttagtcttgggaggatgtacgtgtcgaggaatttatccatttcttctagattttgtagtttatttgcgtagaggtgtttatagtattctctgatggtagtttgtatttctgtgggatcggtagtgatatcccctttatcattttttattgcgtctatttgattcttctctcttttcttctttattagtcttgctagcggtctatcaattttgttgatcctttcaaaaaaccagctcctggattcgttaattttttgaagggttttttgtgtctctatttccttcagttctgttctgatcttagttatttcttgccttctgctagcttttgaatgtgcttttctcgttcttttaagtgtgatgttagggtgtcaattttagatctttcctgctttctcttgtgggcatttagtgctataaatttccctctacacactgctttgaatgtgtcccagagattctggtatgtggtgtctttgttctcgttggtttcaaagaacatctttatttctgccttcacttcattatttacccagtagtcattcaggagcaggttgttcagtttccatgtagttgagtggttttgagtgagtttcttaatcctgagttctagtttgattgcactgtggtctgagagacagtttgttataatttctgttcttttacatttgctgaggagtgctttacttccaactatgtggtcaattttgtagtaggtgtggtgtggtgctgaaaagaatgtatattctgttgatttggagtggagaattctgtagatgtctattaggtctgcttggtgcagagctgagttcaattcctgggtatccttgttaactttctgtctcgttgatctgtctaatgttgacagtggggtgttaaagtctcccattattattgtgtgggagtctaagtctctttgtaggtcactcaggacttgctttatgaatctgggttctcctgtattgggtgcatatatatttaggatagttagctcttcttgtttaattgatccctttaccattatgtaatggccttctttgtctcttttgatctttcttggtttaaagtctgttttatcagagactaggattgcaacccctgcctttttttgttttccgtttgcttggtggatcttcctccatccctgcattttgagcctatgtgtgtctctgcacatgagatgggtttcctgaatacagtacactgacgggtcttgaatctttatccaatttgccagtctgtgtcttttaattgaagcatttagtccatttacatttaaagttaatagtgttatgtgtgaatttgatcctgtcattatgatgttagctggttattttgctagttagttgatgcagtttcttcttagccttgatggtctttacaatttggcatgtttttgcagtggctggtactggttgtccctttccatgtttaatgcttccttcaggagctcttttagggcaggcctggtggtgacaaaatctctcagcttttgcttgtctgtaaagtattttatttctccttcacttacgaagcttagtttggctggatatgaaattctgggttgaaaattattttctttaaaaatgttgaatattggtccccactctcttctggcttggagagtttctgccaagagatcagctgttagtctgatgggcttccctttgcgggtaacccgacctttctctctggctgcccttaacattttttccttcatttcaactttggtgaatctgacaattatgtgtcttggagttgctcttctcgaggagtatctttgtggcgttctctgtatttcctgaatttgaatgttggcctgccttgctagattggggaagttctcctggataatatcctgcagagtgttttccaacttggttccattctccccgtcactttcagatacaccagtcagacgtagatttggtcttttcacatagtcccatatttcttggaggctttgtttgtttctttttattcttttttctctaaccttctcttcacacttcatttcattcatttcgtcttccatcgctgataccctttcttccagttgatcgcatcagctactgaggcttctgcattcatcacgtagctctcgtgccttggttttcagctccatcaggtcctctaaggacttctctgcattggttattctagttatccattaatctaatttgttttcaaagcttttaacttctttgccattggtttgaatttcctcctgtagctcagagtagtttgatcatctgagccttcttctctcaactcgtcaaagtcattctccatccagctttgctctgttgctggtggggagctgtgttcctttggaggaggagaggcgctctgatttttagagtgtccagtttttctgctctgtttttttcccatctttgtggttttgtgtacctttggtctttgatgatggtgacgtacagatgggtttttggtgtggatgtcctttctgtttgttcgttttccttctaacagacaggaccctcagctgcaggtctgttggagtttgccagagatccactccagaccctgttcacctgggtatcagcagcagtggctgcagaacagcagattttggtgaaacgcaaatgctgctgcctgatcgttcctctggaagttttgtctcagaggagtacctggctgtgtgaggtgtcagtccgcccctactggggggtgcctcccagttaggctactcgggggtcagggacccacttgaggaggcagtctgcctgttctcagatctccagctgcgtactgggagaaccatgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgaacttcccgccgctttgtttccctaatcaaacagctaactcggcaatggcaggtgcccctcccccagcctcgctgccaccttgcagtttgatctcggattgctgtgctagcaatgagcgagactctgtgggcgtaggaccctctgagccatatgcgggatataatctcctggtgtgccggtttttaatcccattggaaaagtgcagtattggggtgggagtgacccaattttctaggtgccctctgtcacccctttcttttactaggaaagggaattccctgaccccttgtgcttcccgggtgaggcaatgccttgccctgcttcggctcgcacacggtgtactgcacccactgtcctgcacctactgtctggcactccccagtgagatgaaaccagtacctcagtttgaaatgcagaaatcacccatcttctgtgtcgctcacgctgggagctgtagaccggagctgttcccattcggccttcttggctccaggctatttctttctttttttaaaattaatgtttgtcttgagcctcactgtaagctttccaaggacaggaactgggatccatatactgttgtactcccattatgcaacctaacataccatagtagaagctcaattgatgtttgttgaatgaataaataatccaagagaaataactagatatcgctttatagaaggtttcattagaacccagcacagcaaatgagataggcggtgaatttttaataaagtatctatcagcagcagtcaagatctgctttcttagggtaacacgtgtctctgtgctaaagaaatcatttctccaaaagagaacatggaatccctggtactttgtccttagtttgttttctcatctgagataggaaagcatggcaccctgacaggtaagcaagcagcccttaattttaaatattcaagacagatacatacaatactatctgagtgggggaaaggtaaatctaaaataaatgtctttcattatacagaaacagctgtttattgatttccaagaattgttgtgtgagtgttggtttgaaagggaggaggccatcatgaaagtaagcattccatttgtattggctagaagctgtgaatcaaaatttttcaaagataaattttcctctgtacttgattctctgtcgaagggatgtctatttatcttgtccatgttactgtcatgtttgagagacatactgagcaggttggatctaaaccaatcaagtccaagctttacgaccagcaaatgctgaatttacagtcatgtactcagaaacccctgaataattgaactaaaaaagacactagtatcctgaataattaaacaccttctgttgcataaaatcagccttccccagccctgaaaagtagaattcttttcacctgcggcgggtggaactgtttgcatagtggactacagcagcaagcttgtcagggcacttgtaccagacatgagggtgattatgctatctgaaaggtatgtgcctgtcatttcctaactattgctgcctacttgtttggtcctgcaggaaatcagggatggttacagcaaaacgtgacccagatcaatgaaggatggagggggtggggacagacaaacacaataagcaagcagaagccaggtgtgtctcacactgtcaggctaagctggagcctgaatcgcaaacaccagagactcaaaagagcatctaatctgggggctcagggcaagatggaacctccaggttactccttggctatcttctgcttctttgtgaaactgtgaaatttgcaaagggaaactttcagatcgtatttcattcattcatttgttctgcttgagcataaagcatacttctatatgtatcatatataataagcatcatccttgataataatggccaccatttagtgagcaccttctaggggcagacactgtgctaggtaaaggtaggtcataaaattcactgtcaaaaaagaaacaggctggaaaaagttaagtctattacccatgattacttagccagaagatggcagagcagtgttggggcccaggtctttctgacactagcattcatgctctctgcatcaaagtaaaccacctctctcaaagctgttcctagggattgctagggaaagaagaaaggaagaaacttggaaggatactgaagacacagactagagaaggttagagaagccctgagcacactggcgtgccatctggaacttgggaatgatgtgcatttctctttttatgttttgctattcatgctcaagaaagagcactcacctggcactgggaagcactccgatttttttttgtttttaatgattcttagtaagacttgatctgagcagtcttaataaagtgcagggggataattcaggcctctgttgtggtgggtttcttagccctatcttcataggcagagtcctccttgccctctagatagaagtagtctcctcatttccctctagatagaagtagtctcctcatttccctagtgttgagtcatccattttgagtttgccaagttagagtcaggtagttctggaaggctatatccctgttttcatttactgaaatgtcccagaaggcttgggtggaggtgacaaccacactccatggtgcaggacctcctaatttggagctcctgacttggagtcatcttggcttctcagaagacgtaaggacccttgggctggaaactgacatgtgggtggtccagctgagcctccacagaaggaaaagcccaggtctgttcctgcctattcagattcaactacatttatgaggcctgacacctgccaagtactttgatactttcacgtgttatttcatttcaccctcacatccactctaagaggctgaagtatttttcacatgttatgaattttaaaaaatgggccacagagaggtgcagtgtcttatgcatgatcaggcaccttttgcacagtaaagccaaaaactccgaccttcacacacataggctgaaaaaccaatttagccatctgcagcaacatttaaatttcctttagagtggaactctgagtagcttgttctagcacccaccataccaccccagatcgaggaaagaaagcaaaggggttcatgctttatgaactgaattggccaaggaaattatgattaaaaattaagttagtcagaaaatacagcaatcaatgctttaaatggggcctggggagcaggtgtacccctaacaaaagtataaatggaagttcccagtcaatccctattttctccctctctgggctgcttctagcactgtgaggggccttgtttgcatgctttgggacaccccagtgtacatgtcttagctttgtgtacatctgttgtcaatcaaatgtttgtattcttccaaaattcatatgttgaagtattaacccccagcatgactatatttggagatagggactttagggtatagttaaggttaaatgatattataaggatgaggtgctaacttaatagaactagtggccttataagaagaggaaaagagagatctccttctctccctattcctgtctcttcttcctccctcctagtgacctcagagaaaaggccacgggagggcacatctagaaagcagccatctataagccaggaagagagctctcaccagaaactaaattggctaaatccttgaccttggacttctagcctccagaaaataaatttctcttctttaagccactcagtctgtggcattgttacaacagtctgagctgactaatacaacatcctatccaaatagccactgagcagaagctcacttggtcctgtaagtggactgaggctagggttgccacaaaacacaaaacatagaggattcccagttacatttgaatttcagataaatcacaaaaaaatttttaagtattaactgtgtgttaagcattgcatgggacattataataaaattttatttgctatttatctgaaattcaaatttaactatgcaccttctatttcatcctgtatttttacttgctaaatctggcaaccacaactgaggctctggtcagggagctccagggacctcagtgttcacaacattgtctaatgtttaagggggcctggtcagggagagttgggccttggataggcacagccctttgttccccagactacctcatggggaggggccctcttaggcttgaggcctaggaaaagggctgctcttgcccaggtctaagggcaatattggtagcagatagcttggaaaggagtacatgagaagagcttgaatttaggaataaagagacccaggatccatcataagacttgggcaagttacttaatctctctgaactttagatacctgaactgtatgtaaaacagagctttacatggaataatatttgtgagaaaactatccccatgcttaacacatagtagcacatagtaagtctcaataccagctgcttctattgtcaaagaaaaagagatatggtatgaaaatgcttgagtttccttgccttctggcttttttttttttttgtcacggagttgattcgaaccagctgtgaactggaagagggtgttaggtatttcaatttgcccatgaatgggttaggaaagggttaccctgtctagtggtaaccatccgggaagcttagcagtagagactaggctaagcatttcaggagaggtgagagagaacttgatcccttctggcccatgaactgatgtgtctccctctcccctactgttattcacatgtctctggggcctggtgggtaggtgaggcactgtccttttcaagaaggcagggaaagagaggtggaggagagagagcagagcagccaccctacctgggcagaagatgctatgagatatgtaaatattctcttaattcacctatttgtttttccatcttcaaaggagcctgcctagatgagaacttaatcccatgggttgtaactcaggaccatgaggatacacacaaagggaacccaaggaagctggccctaaggctaagtgctgagtgttggaggaaatatataaatgaacttggaacctcatgaaagctcaagactcttctctcaatttcagtctcattcccaagcatcacgctgtgggatttgactcagggtgtttcccttgttaaaagtcaagagtaagaagtagggggtgaaggcaaactggcttggggccaaactaagcagcttcctttttaacttggatgtattaatgggagtagaacttttttgaactctaagattggcactcaggttcctttctttcacagattgtagcggggttttaaatgactaggaactgaaatgactatgaggttggtcatttcaggggggttttgaggccctaaggctagagaagtactgcatttagggtgagcaaaggggaggaaaattccaggaagagggcttctaagaagaggttacctagagtacaaatggacatcgattgatcaatgtgaccataatactttcaccagccccttctgcacctgggaaggtctctcataaccagttacagagtctctgcccctgaaaggctactgcatcaatagattctctaccacacgcagatgaattgaggcacagtttcaggagtcttaacttcataagaagatgctttctctttcctcatctcctccctcagatccactctcctcctggaagaaagcatttctcattctgttttaaattacagtaatgaagatgtgatatgaaataatacaaggtaggtacctttaccaatgaaaccacgtgtcttcagaatctatcaacacctgcaaagacacgcatccagtgctcacctggtgttaacactgaagttttcttacattcaccatattaggacccaaaagaaattactcccatagacttatatgaaagttttaatctgaatgagttctgaagtcaaataattaagcacctactgtgtgcaataaaataagcacaatacaaattaccagttcaattcagcaggtatttgttgagggtccactagggaagcatgtagcataatgatggctctgaggtcatcgcttatgtctccatctgtacctcaccatccactagttgtgtgactttttgaaggtgattttaatccctctatgcctagacctctcagcatacagactatgagagtattacttaattgggctgttgtgagaattaattatcaagccttcatcatagtacctggtacaaaatagttgtttaataaataggtcaaaggatgcaaggatgattacatgatctctgtcctcaagaagcttacagccttgagagaaaataaagataaattgccatctgtcctaggagaggggtgtgccacagtgctaaagggaccataagcgagtaatcccagcctaaggctgagtagagaggagtgggaggaggttgggggtgcaagccaaacctgggaagatgatcaacccggagttagccaagctgaaggagcaggaggagcagagatgcaagacagtattacagcttctaaaaaacatggctgcaacatcaatcgccaccttgtttcacttccaccaatgcctattcctctctaaagcaaatctagctgccaccacttttaaagttcaccttttcattctcctctagaatcttcttgaaattctaatgacctgccagcctcattcaccgaaagcatctcctgttttgatcatcctctccaccatgcccatcctatggactaacgcgccagcaggtgctggcccaatattctggcagccgctggccaagccacaggagatttgacattctttttcctgccccccacagtccccaacattaacttgactaaaacactcctttgcctcagtctaccagtccataaaataaaagcatgcattctgaccatttaggtagaagaagacttgtaaattacaaaggcttgtggagtcctgagaaatagggctaaagaaacactcgccacttaaaatagctaactaaagaggaaagacttcctactcgatgcattactgggttagtgggttgattttatcacatccaaggttgaatgcttcctatcaatcaactgcaaacgaggaaatccagagctttggctccagtaatgtgcttcatatgttcagaattgtcctccaaatcagcaactgactgtagtggtccaatgggagaagacagctgttcccaagtcagggccccagctttcaaggctgtgagtgcagggaagggcagggagccatgaggacactcctgaaaattccaacttaaggtggatgtgtcggattttatcttctctcaccagctctgactccgggatgcaacacctgacatgagaaagagcctcctcctaaatagctgcggttaaaacatcctaatgctaattaaaaacggagagcttagctaaagtggaaggaaacattgctccattaatggctttgtcatttgctaaaaccttatttctttgctgccttcaatttggttaattaatctttcactggtgatctagtgctgtcagcgaggcaatctatgcaaaccacatctctaactccagcctgttcttcagcctttgaaaaactggggggatgggtggtggttaaataaccaatctacaagccacttgcaaaacgaaaagtttcatttcccgtgcataaggtgccaagacctttcttcaataacccagcagtgttttatttctcagctggtggaatttcaaattagtagagacttccgtggtttcttacagacctccttggttacagacgaaaggactccacacccaccccccatattgtgggtgtttttactactccttttattgctaagctcgcacttatattcttttcactttctttttgcacaatttttaaaaaaattataaattagcaccttcattcccttcatggttggcatctgctgtatttcaagtgagaatgcataaaatcctcttctcatgagactatcataatcagaaaaacacataagcagaatgctgacataccagctccttcattctgcttttgtgattctatttatgaaatatttgacacatgcaatgaggtgttatttataaaaatttgcagcatactaaacagtatataatactgtttgtggatacatatatacatgagtagtaaaaatattaaagcatgttagaaaattataagcatcatcctcagtatttgagggtatcttcaatctgagatcattttactagccagattgtaacacgcttacacatacagacacacacacttacatgtacacacacatttgctctcaattttgttatatatatgaacaaagcattctagagttttattaccagcctagacaatgtcttagaagacttttaatttttcctttaaaataaaaggaaagcagagcaaatgagatgtggtcaatgggggtgatgccatatgacctcactttttgggggtgtttgactgccttccagtagcttgcctcctgggtccatttttgaggcaggctctggcttggctccaggccagtgtgacaatcaaggcctgagaagtctcttctttctgagataatttctcaggtttctttgttttattggtggatagaaggagggacctcgagaggaagggagtggggaggagggggatcaggcggagatttctaaactcaaacaggaagtccggctgctgtcccagcctgtgaaactgcgctggcttcagcagggcagcccatgcaggatggcttaaagttaatccatggagtctgggccactttggactaattcctttgagagtctccaagcctccaaggagcatctctgactctggcagaccatccaaggtagttttgaagaaaaataaactcagataaaaaagaaaagaaaatataaactatccggttaaaacgtgtgcctttaaacagctatgggccagacactaaaatgagtttacaagatcccaaggagacaattaaggaaagcgagaacaagtgaaaaataagatgctcatttcagcattgtaaagagcaggaaggagggaacattatcagaaagacagcctttaagccagcactgagggataaaagagaccagatggccctcacccccaggccaggcagaggacccgcccagcccctacacactgcgccctgtgaaatgcatgcgtgcagccctcagatctgtcagatttatgcttgcctttgcaccactccaagaggcgcaccagtgccgaacatctttgaaattctgttggattccaagtgaaaaatcattctgccttcaaagctaaatggaagtttggtagatgcatgtgcttttcccttaggttcaaaagagaaattactctcctcaccatctttatgcattcatagtttcctttttcaagcaaaaagggaaattatgatggggaagcatcctgtaaaagcagaaggtattatacaataacagtactgcttctttatagaagcaaatttttctacattttctttaaaacagaaatgtagtttgctttcatccaatgcagtatgtttacttctcttattttaaaaaaaatctgtggttttgatagagtgtcagcatcattatttgctcacatctcattttaaacattttgcaaatgtctgaaataatgtacataaacctttcaatgagttagtgctagatgcagaaagtacaggaaattgtcacatcctaagtcacgtattcctgtggaggttttttagcggacatgagaatatgtcataatgggaaaaataaaaaaaaattattgaactgtgattatgcattaggtaggccctagtgacacagaaaatagacaaagatcttacaatccatggttcctgccctcaaggagttgatatctagtgggaggagagaagaaggtggagagggcaagtaaacaaatacctgtgattaataccaagtgacaggtgctataactgagttaagtatcaagtttcacgggttacctatgaaggagcagttatttccacagaactgtgactgtatcaaggaaacctacacctagatggtattggtgagacaagacaggtgagaggatcccagagagaggcaagaaagccaaagagaggtggaagtctatgatgttttctggaagccgtaaggagtccagtatgggtagagcatggcgactgggagtggcaaggaatggctaatgatggaatggaagtgtgggtttggagtcagaagcagttcatcaaaggcttagattgctgtactaaggaaggtggacccccaagccatggtgaggagaataagcagagcttagaaagaacagcttggtcttcagatgttgtgttaaaaggtcaagcgaattgagatttttggactatggaagtattaggatgaacaaaatgcagggagcgataaagtcacattggatctggagagaaaaagtagatggtaaacttaacaacaaagtttaacttagtcagaagagcacttggctaaaataggagataatagtagctaacttttactgtgtgctattatattcagatccatgctaatccttatttaaccttcaagactaccctataatttaggtactattattatagttgttttacaggtgaggaaaatgaggcaaggagaaatttagtgaatagcctaaggtcaccaattagtataagggggagccaggatttgaacacaggctgtccaacgtccccaaaactctatgtatactgttcacagagaaggaaacatgctctgtaaggaaaagaaataagatcatgtgtacataaattttcaggttgctgcaggatatcaaggtagagatttctaataaatagctaagaatataggtctggcactcagagaaagatgcactcattcaacaaatattatttcctgagcacttattttgtacctgatgctgtttcagagctggagttatagcatcatctaaatattaatatttatggagcactcacatgtgaaacatatgtacatgaaattttggtaaagcaaaaatttccatcacacagctgaacacatactctctaactcagagatagctccttctgcaaaacaaataattcatcccttaagcacctgtttttgcaatttcagaattacccatactggattttcttaaagcaaagcaccctataaacatgcaaacattcagtcaggaggaaagagttcattttaattttacgaaccactcagcatgtgtgttgggcttaggaaataataaaataaatatatctcagtcatttgtgttgatagaatttaatgagaagactacagtaatgacaagttactcacaggtcaacagaatgcagatctccctcaagaaaagagggaaaaaattcaatcacaaagttcaagatcatgggaaggaagggagaagcccctgacatttggcctgccctggtctgtgggccttggaatccttcagcaactgcagttgtactgtctgcctgtatagctaggcacatgtatagccaggcccagatgtagcctgacaggagcacccatgagggttccttgcatctgcaccagtcccaactgaagctgccaccaccaccctatctccactgccaacaccaatgcaactactgagtgagatttgttctaccttaactatgcagaggagatagcaccaggatccctatttatttctgtgctacatgaccattatacagtgtattgcattattttgaagtgagactcctttcacagaaaaataacatgtgagaccacttatatcttgagcttagatagcaccttctgctaagtgcctctgcttactttcagatattatctcatgaaatcttcacaggtttctctattggaaatatttttcagcagtggcataaaagtcagggcatttctatgaatatatgccctaactgagggcatttcctgacatctccacccactaaagaaccaacagattattttcttttcaagcaaatcccatggtgctatcatccttacgtaagcatcagcaggccctcaccaagaactccaagcacatacggtccagccttgcctctcccactgctgtggtctgaatgtgcatgtcctctcaaaattcgtatgttgaaatcctcacccctaaggtgatggcattaggaggtagggcctttgggaggtaataaattatgagggtgaagcccccatggatgagactagtgcccttataatagagagttgagaacgactccttaccgcttccaacatgtaagattaaagtgagaagtcaattgtctaccaggaagcagaccctctccagacacccaatctgccagtgccttgatcttagacttctctgtctccaaaactgagaaacaaatttctattgttggttagccaaaagtctatagtatggtgttatgacagcccaaacagagtaagatactttgataattttcacaatcaactgttttccagagttggagccttttcaggcgaccatcacaaagaaccaacaggccacatagcataacagtttaagagcatgagtttgaattcaaacttatttactgtgcaaacttaggaaaggattctaacctctatgagtcttagtttctttaactgtgaattgggaataataataatacctcctgctatgcttatgagaattgagttattacatacaaagggcttagagcatatggaatgccctcaataaatattcttgattatatccacctgtctgtccacacacgtgtaaagcaaagagcatgaaagtggatgtcagaaaatccagattccagtgccagttctcctactaaataaccgtgtgttcttgttaaactcaatgcctctgagatacagtttctgattcctgagttggaatggattattccaaacagctgactttttgggaggcagctgcagctggcactgatagtgaatgcaaggaacccgtatgggagctcccaccagatctccaacatggattttatacatcgaggatctttgtgccttggctcaaggccctaacaggtactaaagaaagatttcaaaaatagagcacatcttatttggttcgggctgctatcacaaatatgccataagctgagttgcttaagcaacagaaatttctcacagttctggaggttgggaattccaaaatcaaggcgccaacagatctagtttatggtgaaggcccttttcctggtttttagatgcccatcttcctgctgtgtcctcacatggaagagagcagataaaaaggggcaggctctcttgtgtctcttttataagggcactaatcccgttaatgagggctccaccctcatgacctgattacccaccaaaggctccacctctgaataccatcgcattggggatttagactttaccatatgaatttggggggccacattcagtctacaccgagcatttctccaacgctgcctcacaaatagaattctaaggattcatttttcatcttatcaggaacagagtaactatccaactgcaaatcctgacaatgtacaactatattgttagcatttacttctccggggcacccacatggcagacctcctacagggcacttaaggacaataagagagtctctaaatagttgtttcctccagagatatattcatggttcttcctggtcctggtctccctttctccccctggaagttgctgaatgtagaccacagcctgcacaggccagggagcccagtggacacagcagaggctcaggctggccaaacttattctcaagacaaagacgatgaagtaaagcagattctggaatcagcctgcctgcctatgagtcacacaagttgtgtgactttgggtaagttgattaatctctctgggcttcaatttttcatgggataaaaacatggatgataaagtatataactaacctggttgcctcaaagagcaattgagatagttcatattgacctttagtacaatgcctggcatattgtgagtgctcaaaatgttagctgtgattataattatcacagctctgccattgtataactgtgaaccatggacagtttacttaatttcctgagcctcagttttctcatctgtcatctggggacaataatacttaactgtgggtttgtcataaggattaaatgagatagtccatctgggcccagcgcagtgggtcatgcctgtaatcacagcactttgggagaccaaggcgggtggatcacctgggccaggagttcaagaccagcctggtcaacatgatgaaactccatctctattaaaaacacaaaaaagtagctgacgtggtggcgggctcctgtagtcccagctacttgggagactgaggcaggagaattgcttgaacccaggaggcagaggctacagtgagctacgattgcaccattgcactccagcctgggcagcagattgaaactctgtctcaaaaaaaaaaaaaaaaaaaaaatgagacagtctgaaatgtcatgtagcactgagtaataatatctgctattattaaaatcatgactattattatttataattggaagtgaggaaggagtggtcacagcagctgaggtgactcccaacactgacctcttacacccagaaaataagccttacacatagactcatctgtatagattctcctcctggtttcatattcaaataaaagaaaatatgtacaatttccaaagtaactcagaatctaaaacagaaaatttacatttataaattgtcttggggaggaactaattttcaatttttgctaaataatgagcagagaaggattttaaaccaagtcaatacatgagaacaacaatagcaagacctgttatgattatcccagtctttctatgcatagtatcatacttaattcccatagcagctctgtaatgtagatagggaaaggatcaccaagcccacttagcaggtgaggaaacttgagactagaataataaatcatcctgctcatgctaggctatggtagaaccagaattagaactcagatggcctggcccactgtttctccaaaatcattctggaagtcctacaggtcttctcctcaaaatgtttagtgggtgacctttagactgcagatgacaatgagcccccatctggtgttcatggcagacatcaccaatcaacagctctttcctaatgagccccggagtcttctttaatagatcccttcaggagccataaccacttgatcatatctggcaagtgaaatgaaatctctctgttgctcagacactagaccttgaagaatgaaaactcaaatctttatagcagggtccaggctggttatggatataaataaaagagtgggaatgtcagtacccatgcacgcctcatgtgagtgtgctgaacacaagagcctatgtcatggattaaggaacagccaattcacctccagctaacgttttactatgttgaagtgaaagctcaacattgttatatcttaatttaaaaaaaagaaagagaaatctaaaatctacatggtatccaaaatttcccaattatttaatactatgtagcctaaacagaatgactatatgggtcacatacaccatcagtttgcaaccttaactataaaccaagtctagtgatccttcccattctctgaattctgagcatccctgtaagcttgacagcctgattcctcgaagcgcacttctcacctcgattaattagatcactgagatgcatttagatgagctactcaaaataggcaaggcgccagctggctccagtgttcgcttcctccagacagaggggtcagatttagtctctgctggactcagcccatagagaagaaggcagtgaaaaaggaaaagcacatcttcctttatatgacgaggaaagccagcaaaagacacaaccaacctttgggaaaatcttgaagcctacatttgtctctgagaattttctctctacttctctactactttctcctcccaagcctctcatactcttaggtgtttcctctcagcaaggtcccccaggtttgtccccacccacccttatccccttcttagtatcctttatagaagcagaatgagtctagcaaattccttcatgagctttctcatcctctttgcaaacatttcaaacgagtaaactcagattaaagctatgctaacaccaaggaaaaaaatgaccaaaataatagtcataactttctctaagtagggaggctatgtacaatttgcattttcttcattaaacttttccatgtttgctcaatctactgacattaacaatcatcactttttaatagggaggatgggagctattttttcacaaagagaaagcgttaataagataaagtaagtatcaggaattacgtaataaactggtcaagttacatggtatatcagttaagatacctttagctgcagcaatttttaaaaatcttctccaattgattcaaacaaaaaaatatttctttgaaaccagagatttagaagtaaacctctcctaagatggttccagggatgggtgattcaacagctcaatgattctccaagatccctctgtcacccacaacatatcagttgtaagagtcagcttccctcatggactcaagatgctgctgcagttccaggtattatagccatgctccacaatgtccagaggtagaacgggattggcctgcctctgtatccttactgaaacacgacatctttcccagaagcttaagccagactttgccacatgcttcactggccaggacttgggtcacctgcccattcctagaccaatcactgtcaaagggaatgggatctccatgaataacatgagagaattatttcagttggaacagatgttgggaggccagccacaaagactacaagacaatgtgttcacattatgaatgaaagtagactgctatggacaatgagaagatcattataaagctcattttgaagggctcggagtccacaaatattccatccaaagggtatgtctggaaaggcatatgagttttattcctaatattgccttagatttatgtagcaattaatagtttgtattgtactttctgacaaacttccccaatgatatttcatgtattcggggatgacactgtaattattatcccatttcacagaaaaggaaccagctgagcactgtgtctggtgtctcatggctagcaagagatagaggtgggacaggatgccatgctttttgacacttagttcactagtctttctactacaccacgtgactttcactataaaaatgctcaacagggatagagcacttgtttccaaagtacacacacatcatgatctcacttgattcccaaaacaacattatgaaacattaggcaaggtggagttgtcttcatttacagatagggatattgaggttcaagcaggctgatggtaagaaactcaggtttggatgaattgaactggttttatttgttttgctttttactaccaattggcagttgttgttgttgtcttttccccttgctccttctcaacacctgatcctaaatcagcaagcatgtctccaaaaaacatgggatccccactccaaattttcatactctaggaccccttctggtaccagactctattcctgtctgttatgcctaactaagtagctggtgcttccttatgagctcctgacatcgcccctttcattgttgcctcaggcttctctgaccttccaatgggatcattagttaatctcatcaactaatttgctaaagaaagactccaggctcttcctttctagggaagaatagcaatggcctgttagaaacaaggcacccacttttgttgcctatcccaaggcaattacccctatagtgggaattttaggataggctagagggaagtcttgactgttagatagttaggagcctggtctcttaactattctaaagcagggcaaagaaaatattatgatgcagtagaaagagcactgacctgggagaagacatgcctgctatatgatcttagtatctaagctcccatttacaaaatatgaatattagctccagcccagcatactttccagagtttttacaagactttatcaaagcattcatgaatgcactttgagctcaacagatgtgtagttattttattaaacagttgcatctaggtgagtggataccttgtaatttggcattacttcaataataattgtttgtaccatcttacttccaagtgtaacaggtagataaaaggagagagaccaaatctcactattgtttatccaaggccaatgatccagggcagggttctcaaccttggctccgcactgggatcatcttgagatttttataaaatgtgatgtccagaccctactctgaaccagttaattcagaatctaatctctggggaagtggggcccaggcatcagtactttttattagctcgccaggtgattctctgtgcagccagggttgtgaactgctgcacgtgagtgatccagtagcagagagattaactggattctttttctttcagtcatgcaaccacacttggaggagagagtgacacagtcagttcacggggggtcagagcatccttggttctctttcttggcactgggtcaggtgtatgtcatgacccgttctgggcaccgcaattacttcttagaaccactggatgcttcataccaaatgctttacaaatgtggcttggggttggtaaaggaggaccaatgagggagaatggtgtggaagagagggaatatgaggttgaaataaagagataaaagcaaagagagagacaaagacaggcagggagtggggtgcagagaagcagaagcagaaaataaaactgctgatagtagctttcagaattcagacctgctttcaaaccatatggcagagatattagcttgtctgtaattactacaacattctcaattgcagaatgactttcattaaaacccatggattgaggcacttggaatttgtgaataattcttactttgagctctggctctattatgcctctgtttggagttgatgtttcttagggagggtgagactccacttgttcatcaagctgctattttagaaataatgccatcaaaatcaatttaatgagcatttgtttagcacccactgtgtgccaggctctgtgctaggagctgggtactgggaatagatatcccttggctacatccattcaacaaatgtgttcaatagcaacacatgccaggcactgtgtggggtgatgcaggggcaggatatccctagcagactgataagaatacaggcaattacttgtggtagagtcactgtatgtaacaagttgtacctctattaatctgcttcaggtggtgaagggaggagaagggtaactgcattcatctttgaccaggagggtacctagactaagtccatagtgaccaccacttagtggcccatgaaaaaggcagaagtgacaacttctagtttcatgacacaatcagattccaagcaggttcctggatgggggctgtattagtccattctcacaattctaataaagaaatacccaagactggatgatttataaagaaaaagaggtttaactgacgcacaattacacatggctggggaggcctcacagtcctggcggaatgtgaaggaggagcaaagatacatcttacatggcagcaggcaagaggcatgtgtgtggaaaatcccctttataaaaccatgagatctcctgaaacctattcaccatcatgagaacagcacaggaaaaatccacccccatgattcaattacctcctacaaggtccttcccattacacatggagattattacaattcaaggtgagatttgggttgggaacacagagccaaaccatatcatgagttgttattctacctctctggaatgaaatgtgaccaaagttcagggtttagcgtgtctaatatctacgccatcatccttaatcacttaccacttagctgagagatgacaaatggtttcattttacacattatctttgatgcactggtaatgactgcctagagtactgctaataagatttctgggctcagtgagataaaaagttttgccatggggtggcattaaacagtgtagtttccagccctgattttgcccaatctcctttgttctagtgctgtattgttccacaataagctacccccaagttagcggcttaaaacaccagttcttagttttccttgtgaatctgcagtttgggaagaactcacacaggacatagctcatatctgtatacatggcatcatctggagcagctcatctgaggcaggaggatccacttccaagttgattcactcacattgtctgagagctcaggtgtagctgtcagcgagggcctcagttcctttccacacgagtctatctaagaggctgcttggatttcctcacagtatggagagtggaaactaagaaacagcaagtggaagttgcttagatctttagagttggtcctagaaaatggcccgacatcacttttgtcatattctactgatcaatgcagtcatagaacacattcaggttaaaaggaatagaaagtgtgtcaaagaattcatggtcatacttaatctgccacatcattcttccattttgtgaagcaagttgagcccagctccgattgtttattgtcttagtccacttgtgctgctatggcagaatactacagaccaggtaactgataatgaacagaaatttatctgctcacagttctggaggctggaaaacccaagatcaagggtctggcatctggtgaggccattctttatatataatcccatggtagaagggcagagagtgagagagagcaagaggattctgaactcatcctttcatatcaaacccattcctgtgataacagtattaattatttcactgccctcatggcctgatcatctctcattaggccccacctcccaacactgttgccttggggattaagcttccaaagcatgcctttggggagacacgtttaaaccatagtatttgctagggtagttcataatgaaaagcataagggaagctcaagactaatggcttgaaaataaaatggtgtagagtgtgagacctctagttgcaaccagctctgctctgatgtgtccttcctgctaagcctctgctcttctgggaatactcaagaactccaaaggctacacaatgaaggcagacagtcctgccaagactttgccaatcatttcaggaagtagagtgtctgggcctgcacttcacaatttttttttcctctctcagttaccaactggggcttgcactttctatgttgtgtttcctgccctactgctacctcttgggtaactgtcccaagggttctcttcttcacctttctaatccttacatgctctgccatcaagcattataaatgctgtgggattcctaatccaactgtgcagttcttaggttcaggggagaggttgggatcagattttctagagccgtgcattcagtgagggctttctgataccctggagatgattcatctaccatacctagacagtagaagcaacctctggaggtaatgagttgcaagcaaacttgtagttctttttactctttttatttgctcctgccatgcccattgagcatgaaatagtccccaagggtagaaagaaaggaaaccaaaaagaaaaaaacaataataaaactccagcatgtacacacacacacacacacacacacacacttgcctaaagtgaatgagcatgcagagccagtattattctctttgcacaattaaaagattcttgtatttgcctttggttactgaaagcttaatcatttcagagaatcagagacttcagcactttcagctcgtgtaaatgagaggcactatcaatctgtttttaaattggttgtgggtcttctgaggtctactatttcagcttatacccaatgcctagaaattttccaaagtcccttgttcagcagtatacacagccagactggtttgatcccaattgcaattagtgataaatacatcataagattaaaaaatattttttaaggcttagagatttaggaacaaatacactccaaaaaacaagagaaacactcaatctctagaaacatcaaggtcctgagttaaaatctacctctttatagttttcagtcaaattgtaagtcctggtgcccttttttttctatagttgacttaattctgtatctgtggtcccaatccttctgatcataccagattcattagtactgcagaaaggaaaaggcactggtgttaggactggtgttaggattaagctcctgccttaaactagtggcgtgtcattgggcctctggaaagaagcatgtttataagtacagaaagagaggtgattttaaaccagactgagtagagtttgaatcccagatctgccggttactgacttttattaactaggccagtttccttaacatctctaaatttctttcttcctcatctgtaaaatgagagcaaaagtacccaatttatcagtttgttatgacaactaaataaaataatatatggaaatgacctggcacatagcaaaccctcaataaataatggttcccatcccctgagcctctggtttttctaaaacgagtgggctcactggcttgacatcaccatacagaaacagtgttttccatgacactggcatggtcccttagctcatggagtctgtgtgtaaacagctaagaaaagggggctgtctaaaaatatccttaagacctaactaggaagagcaaggtgagtgctgagaataaatcaatagtgtccttaccttaaaacctttttgcattatagatttcctctccctaaactcctctcccaaccccctacacacaccccatgtggtagggagaataatgactcccaaagatgtccaagtcctaacatccggaacggtgatatgttacatcacatgggaaaagagtctttgccaaatgattaaattaatatgtgtgattatcaattttggctgttaacttgaccagattaagggatacccagatagctggtaaagcattaattattctcaatgcttcagtaagcactgagcctatccctcctctgttcaaagagaaacacaggtggtttggcatttgattagaatgattgggctgccccaggtttatctttgagggtgttttcagaggagactggcatgtgggtcagtggactaagtgaggaagatccaccctcaacatgggtgggtgccatccaacaactgggggtctggatggaacaaaacgctataagaagggcaagttcctgctgtctcttctggaaccaggacactcttctcctgtcctcagacgtcagcactctaaattctctgactttgggctctgggactcataccagcagcccatgggcctttcagcctttggcctctgactaataatttcaccatgaagccacgctattggcttttctggttcgccagcttgcagatggtctgtcacgggtgttctcagcctccattatcttgtaagccaattccctaatgaatctcctctcatttatctatctatctatctatctatctatctatctatctatctatctatctaccttatctatctatctatctgtctatctatctatctatctaatgtctatctatccatccatccatccatccatccatccatccatgctacagattgtgtctctctggaaagccctaactaaaacattaagttaaaggctctgagaaggggagagtatgctggattatctgggtggttaaagggactattaaacatggaagagggagacagaaggagagagtcagagggaaatgaaacctgggaagaatagtaagagagatgcaacattgctggcttccaagatggaggaaggaaccataagccaaggaatgtgaattgtttccaagaattggaaaagacatgaaaacagattctcccctagagcctccaggaaaaattgacgccctgctgataccttgattttagcccagtgagacccattttagatttctgacttccagaattgtaagattaaaagattatgttattttaagccacacaatttgtggtaatttgttgcatcagcaatagaaaattaatgcacacagatattactataaccattttgataaaatcacatcaccccagccctagagaaaattctttttaatcatactgctgtgtgggaggattaaattttattaaccaaaaaaaaattagtttgtttttaatatatttatcacactcgccctaccctgcccagccaagataggagatgagcagtggttgaagaaaaccccttggaagctcctcaaagaatgaatgagttatatgcctactgtttgggacagagtcagagacatcaactgaaacttaatgatctcaagtctctggagagagacttgagatccaaatagtccccagtagtcatctcaagtcttaatcatctcaagcctctggagagagacttcagattcaaacagtccccaatagctatgatttgaatgtttggcccctccaaaacttgcgttaaaatttaattgccattgtaacagtattaagaggtaagacctagcagggcacagtggctcatgcctataaccctagcactttgggagaccaaggtgggaggactgcttgagcccaggagtttgagaccagcctgggcaacatggcaaagccccatttctgccaaaaatatgaaaattagctgggtggcatacatccgtagtcccagctacccaggaggctgaggttggaggtcacctgagcctcagaggttgaggctgcagtgagccatgattgtgccactgcactccagcctgtgtgacagagtgagaccctgtctcaaaaaacaaacaaataaataaataaaaggtgaggcctttaagaggcaattagaccacgagggctccaacttcattagtgagcttagtgccattttaaaagggctggtttggcccttcttgccctctcttgcccttctacttcctgctatggaataatgcagcaagaaatccattgccaaatactggcatctcaatcttggacttcaaagactctagaacttggagccaataaatttctgtttattatgaattacccagtctcaggtattctgatacagcagcaacagtggactaagaagccagtcatccaaaagaaaactactaattaagaaagttaatgggaaataataactttttaaagtgaggtgtagagaaccttttgtaacactagggatcttggtttctgggtagctaaatacaattagatatcaattttcaatttcattttatagaaatccatatgacatagctcaggattaaaacactgtcttagttcattttgttctgctataacagaataccacagacttcgtaatttccttttttccatctccattgcttttatttttttacttttattatttcaataggtttgtggagaacaggtggtgtttggctacatgaataagttctttagcagtgattgctgagcttttggtgcacctatcaccggaagagtgtacactgtacccaatgtgtagtcctttattcctcaccacccctcaccctttcctccgagtccccaaagtccaacgtatcattctttctttttttttttttttttttttttaaagacagagtctcaccctgttgcccaggctggagtgcagtggcgtaatctcagctcactgcaacctccacctcccgggttcaagcgattctcctgcctcagcctctcgagtacctgggactacaggcacctgccaccacacccggctaatttttgtatttttagtagagacggggtttcaccatattggccaggatggtctcgatctcttgacctcgtgatctgcccgcctcagcccgggcagtaaagtgctgggattacaggcacgagccactgcacccggcccaatgtatcatccttatgcctttgcattctcatagcttagcaaccacatatgactgagaacatacaatgtctggttttccattcctgagttacttcacctagaataattgacagacttcataatttaaaaaaaactgaaatgtatttagctcatggttgtggaggctgggaagtccagtgtcaacaggctgacatctagtgagggccttcaggctgcattatgccatggtagaagtgcaaaagggaggataggccagcaagcatgtgtaaaaagaagagtgccagggtcagacttgctttataacagcccactctctccaaaactaacccactcctacaataacaacactcatccattcatgagggcgccgccctcatgacccaatcaccacctggtaggccccaccacccaacactgctgaattggggattaagtttccaacacgtgaattttgggggatgcatttaaaccacagtactatcataactgtattttcatttttctataaagtttactatcttctactggtaaagtaaagcctggccattttgaaaatttgtagaaaacaccaaatcttttttttttttttttttttttttgagactgagtctcgctctgtcactcagactggagtgcagtggcacgatctcggctcactgcaagctctgcctcccagattcacgccattctcctgcctcagcctcccgagtagccgggactacaggcgcccgccaccacgcctggctagtttttgtatttttagtagagacagcatttcaccatgttagtcaggatggtcttgatctcctgacctcgtgatccgcctgcctcggcctcccaaagtgctgggaatacaggtgtgagccaccgtgcctggctaccaaatcattttttaaataactccataaacaaaagacaacattgctaacatgttacattttctctgtacagataggaaaaggcagccccaaaaagagaaataatgctgtaatactattattctctgaccaagcttgcttccagcttactcagggttttacttataagcaaataaaactgacatccccaaaggagaaagattccactggggttgggcgaacatggtttgaatctttgttttggcatgtcctacctatgtgaccctggcaaatgagttattcccagcagccgaagtttccttgtctataacatgagaataatcagacctattccaggctatacatgaggactgaagaccaagtgcctagcacattgcccaataaaggaaagtggtcattgttggctcacaagtaattttttcaggaattctctggcagaaattttttcaggatttctagcagctttgctggccactggcacctcagagctaaccatagccctgctgcctgcgttaaaagcccatttacctcagtacagcccagaaataacctctaatatctacaactggggaggtgcttattttccacttatgaaaccttatcatgagcattatctcatttcatatttgggcaccagcctgtataaaatggaaaccatcggctgaatttgtttagaatctgccatctggctgcttccccctggctccctgaatgaactccttctgctggaatgttctcacccattctcttcccactctctgcccctcgtcacgccctcctaggtgtctgcactgaagttagtacatttttccactgccatgtgtgcctttctattctgcagggttggttttgaatcttttttttcctaaccttgagaacaggaaccatggtgttttattcttcccaatgcttggcagagcggcacttggtaaatgtcagttaatgttccctgagagaagaaataaatcagggtggaataaataggtagataaatggaataggtaaattcatgaattgtcctcaatccactggagcctgcacctgtgctatcactgggtgtttcttgtagcccaatacctaacccatttcaaaactcatgtgtacttttatgtttcttcactactggtttgttctgaggttaacctggaaggatagtcagcaataaaattaaccaagacctggatggaggagacagagagagaagaatccttttctttttggtggaggtgggggtgagacaggatctcactctgttgcccaggctggccttcagtgatgtgattatggctactgtagccttcacctcctgggttcaagcaagctgctcacctcagcctcctgagtaactgggaccacaggtgtgcaccacacctggctattttttaaattttttgtagagactgggtcttactatgtttccagggctggtctcaaactcctggaatcaagcaatcctcccacctcggccccccaaaagcgttaagattacaggcaggaaccactgcatccatcagagaaggattcttcacatgctttctagtgaaaaattaggaagccagcaaaattccatgggcaccttcacactgtgcttcatgtgaatagcagtcctgaatcaccatgcactacatgtttacatgaatgatgctttttgtagtagccagcactagtagctagcactaactttaccctatagtatgtgttccttttggaagacttgcaatgttccttggtgccactgggacaaagcccatcctgaacacttccattgttgcaggaagtaaacctgcttcccctctcccttgtgccctcctggatatcccacccgcccccccccccccattaaggctctaacacaatgaaggctttaagtgaacatcatgtctggctgggcagatgcaatctcctctcttcctcagaagtttggatggtttcctttcttgctctgcacctctgagctggcccacgtatctggaataattagctcttgacaagagagacccaatgcttcttcctcctgccaatctgacttctattgtagtcagccctgagggcccccatcccaagcaacacaaagcattgcatgagtccagagatgctcaggtgtaacaaaggcagttaggagcaaggacactaaaggaacaacacctctgttgaaatgtcagttctgacacaacctctctgcacctcagtttccacacctataaggttagcataagtatctacttcacagttcccttgagaggaagattacatgagttcctgcttgtaaagtacttggaacaaagtaatccccttttctcagataactcagttcatctcatccacagtgggcagggccaccaaaaagccaaaggtcaggacagctgcccctgcttcatgtgttgcagctgaatttgcccttctccaaagattctccttaagaaaacatcaagtcaagaacttctgaaacaaatcttttcttggtggaatggtagcatgacaagaggtggaggtgaagtatcaaacacaattggcattcaattctgtgtccatcacttactaactatggaaatttggacaaaagacaatctcagttttgggttcctcctctggaagatgagagcaatcaatcatatctaaattatatagtgtccttgtgatatttgagatcatatgaaaaataacctgtggtaaaatataggtgcttaatatttgtttctctttttcctgacgctaaactttttgttttatagaaaacagaggcctaaaggagttaggcaagttacttaatccctgtaaaaaacaacatgcctgtaaaacatagaaggtggtattaatgccttccagaggtctatcagttctaaaatgtgtaatctctgagttcaagacggctcaggagtcactgttggactgttggagaatcctaagccactccggcaatgagcacagaggcctatctaggattcacccgtgctcccagccctggtacatctgggtctattagcatgggtctttcaccacctgaggatacatccaggccagctggagaagcagcctcctgctaaatggctctgctcttgcagcgggctacagcgggagatccatatcaatggctgcctgcctgcacttctggagccttcctcatcatgtgaggattagaaaggacggacatctatggcttctgtcagagcagccggcagtgggtgaacagacacagtctactgtgtggattcctggtaaaggcagggtatccatgggcctgggttgactgtcataaaagggagctgaagaatagtcgccgagttgttgcgggaagtcagggaccccaaacggagggaccagctgaaaccatggcggaagaacataaattgtgaagatttcatggacatttattagatccccaaattaatacttttataatttcttacgcctgtctttactgtaatctgtgaacataaattgtgaagatttcatggacacttatcacttccccaatcaatacccttgtgatttcctaggcctgtctttactttaatctcttaatcctgtcgttttcataagctgaggaggatgtatgttacctcaggaccctgtgatgattgcgttaactgcacaaattgtttgtagagcatgtgtgtttgaacaatatgaaatctgggcaccttcaaaaaagaacagggtaacagcaatgttcagggaacaagagagataaccttaaactctggccgccggtgagccaggtggaacagagccatatttctcttctttcaacagcaaatgggagaaatatcgctgaattctttttctcagcaaggaacattccttagaaagagaatgagtccctgagggtgggcctctaaaatggcccccttgggtgcggccatcttttatggtcgatctgtagggatgaaagaagcctcagtctcccatagcactcccaggcttattaggaccaggaaattcccacctaataaatttttggtcagaccagttgtctgctctcaaaccctgtctcctggtaagatgttatcaatgacaatgcgtgcccgaaacttcattagcaattttaatttcgccctggtcctgtggtcctgtgatctcgccctgcctccatttgccttgtgatattctattaccttgtaaagcatgtgatctctgtgacccacaccctattcgtacactccctcccctttgaaaatcactaataaaaacttgctggttttgtgggttgtggggcatcacggaacctactgacatgtgatgtctcccccggacacccagctttaaaatttctctcttttgtactctgtccctttatttctctaaacggctgatgcttagtgaaaatagaaaagaacctacatgactgtcgggggcaggttccccaatacccagtctctgggtgttccctatagctcaagacctaactcattctccagataactgctcttctcatagttatagttcttagaccacgaaaagcccttcgataactgcttttcaagtttccacaaagacctcagtaatttttttttttggcacatctgctaagcacctaataaatgtttctttccaggaaaattcagggacacacaaaattataaacaatggcatcccaaaacttgctgaaatatcagacctacatttcacaactttatttttctgaaaattagtctaggttctacataagcaagtttgaaaatctctgtatccttggagattcacggtgcactttatcaaagtggagacactgagcagtactgtaattaaaaggaattgatgccaggtgcagtggctcatgcctataattccaatactttgggaggctgaggcaggaggatcacttgaggccagaagtttgagacccacctggtcaacagaatgagaccccatctccacaaaactaaattaaaataatcagctaggcatagtggaacacatctgtagtcctagctacttgggtagctgaggcaggaacatcacttgagcccaggtgtttgaggccagcctagatgacagagcaagaccatctcttaagaaatgaaaaaaaaaaaaaagctggtttggtttaactgacaaaacaaaaattatcataaaacagaatacttttgaaacaaatttctgtgaagatacaagtgttcttcagacccaatttggaaaatgccaacctataatattttaagtggagattaaattaaatggcttctttaatcacaaagatatttacatcatatagcaaatctagttttcacaataaccatcaccatccccaccctctaacccccacaccaactcaaatttgtccaggtctcctggtaagtttggaataagaatatggcaattgcttacccggatccccctgaaaactcaccttcaggtcagtgagttcagaatgctggcgtctcctagtgcttgtctggccaggacccccgagtgccgccaccaccccacagctacactgtcctgtcaggctctttggtggtaggagaagaataacactctgaaaaaggggttccagcctttaacacagcctagaataggcgctcagggaagactctaaggggaggcattggatgcctcaccttttcatgggctctgataacactttttgagtgcacattccccaagcccagcactgtgtctgccacatagtaggtgatcaataaatgaataaattgtacttggcgtattgcaggactacattccatttagagaatgtttgcctctcatttatgaagttgccaagaggaaacacaattttttttaatttcatgtgtcaagtatctataaagggcctggttcatggacctaagaagagtgggtgaatgagtcaatcgtgtaaggagtgaatgactttgagctttctcattggcccttcctactgggtgccaggaagtgagaatagggccctcaaccctctctcaattacctttaacctccccatcccactgggttgcctggcccctacttttcttcctccaccgtgatgtttcatgcacttcctgccccacagccacgttatctgctatttagctcctttgccttaaggagggaatgggaaatgagtagcctgaggtgcaagtgaactaccttagccacattggcttgagaagattaacactgatgtgggaagcatggcttaggattcactccctctcacgctcaggtgtgagttgttgacagtacattgaaaactgacaatagggaggagcagaggagagggcgctccctcacagccaatagccccatggtcttcttcctctacatcaggccttatgccccactgctatggtttgaatgtctcctccgaaagtcatgttgaaacctaactcccaacatggcagtattgggagatggggcctttaagaggtgattgagtcatgtgggctctgtccttgtgaatggactaatttacttatggattaatgaattaatgggttaatggattaatgggttatcatgggagtggcactgaagggtttataagaagaggaagagagatctgagctagcacactcagctccctcaccatgtgctgctttgcacctcctcaaaactctcagagtctccaccagcaagaaggccctcatcagatgcagcccctcagtcttggacttttcagcctccataactgtgacaaataaattatatagcccagttttaggtattctgttataagcaacagaaaacagactaagacatctacttcttcaggcttgcctctcatgtaaaggattcaggcatccttccagggcctatttgaatatactcagttcacatatcttcccatttgtcccagactcattgcaggcagtctctggcccaaaataaatggtatgtgtgtggaggaactacgaaagagaactcttaagggagtaccattctgggacattcagttttccacattcagggatatcatcttcaacagccagctaacaagagttgaacccactatggaccccttttgcagctaaggatttttgttattgttgctaagaattatttttaggtacaatttagcagttaaggatgcaatatttcctgctttgacaatttaaaagtgacctcaatggatttcagggggtggggagttacttgttttttgcctgaagcacgaatttttatgccccacctaagttggtgtgcaggagggggtcttagccgtgaaggagtctagacactcaaaatctcaagttttgtggctctcccttaatataaatgcatatgaatctttccagtactctggagggcaggtgtttttatccctgttgtataggtaagaaaaggagacgcatccatgatgttggaaactggggatatggctatctcaggaatatccctactataccatgggtttgaatccaaatccccagtgcctcattcctcagctcttctcctcctcccacccatgactctcctgaacttcctttcatttctctgttctcagcaagtaaaagcttcaaaggcaggtggggtacagtaagaaggggcacgagtgaaaggaggagtgttctgggtgtctctcttcattcccagcagctccgtttcatctgcttttcatgtacccctgatagcagatgtcctttaatatccagataagagcaaaccaaacccctattctacaaccaaggagaagtacaacctgctcccccgaccctcaccaagattttttttcaattccttagaggcttaccttctggtagtcatctctatctcatactttgtttttactacatctgtcaatctgagtcatatggcttctttgttccttttgttttttatcttcttcttggcattgacccaaacaaaggacttgaccgctttcttgttgatacctggtcttagtctgttttgtgttgctataacagaatacctgagcctgagtaatttgtgagaaaagaggcttatttagctcacagttctgcaggctaggaagtccaggggcatggccctgccttctggcaagatttttcatgctgcatcataacatggtggagaatttcaaaggggaagcagacgtgtgaagagggaagactggaggggcatcttggctttataatgacctactctagcaggaaataatccattcctgcaaaaaataatccagtcttgtcagagagcgagctcattcacaaccaccagaagggcaccaacctattcataagggatccaaccccatgacccaaacagcttccaccaggcttcactttcccaacactgccacactggggaatcaaatttcagcatgcattttggtgggaataaaaaaaccatagcactgcccttccatatctcacacataaaggagatgtctaggctatattttttactgtagaattgggaataatggtaaggagtttcctgtgtacctcacaggacgtaatttaagagaattagtcataactattcatgacaagccttgttactcagcctctccatccttcttcctcccttctctttgcaacccatccccaccatcaaattcaagtttattacttacaaaaagcctttagctgtttcttggttgccttctccctgaaggtgatttagcaaggtatttccctaaaataaagtgctttccctaaggagctctggtctctgctagagaggtaaagatctttcccagcccaaaggcatacctactcattcattcattcaacaaatatttattgagtgcctgctatgtgacagactctggggatataacagttaacaatgggacaaaaacccgtgtcatcatggagttcacattctagtggaactttgcataaatttattttaaaaacaaaaatgtttttatacaataaaaatttgaaagctgatgtcttagaatatttttcagaaagcatttagaattctactattcctgcctagtcttcttaaataaatggggcacagagggaagaacttgcctttgttctttggaatccagtttccttttttatctccctcctttttaaaaggaccattttcttctctgttccccaggttgtgctagcctcctgtctcttgcttaatcctccctgaaatacacaaagcagcaccatcctcttcactctatcttactctcgctttaaggttattgtctccaaggagtccttcccataaagggctcccatagagccctttctccactcacccacctcagcaccctctcctctcccatctaaattaattctcttgccctatttcgaagatgttgtctgtgctggctggatgtgctgctttgtagatcattaaactgtcccccatataatttacagatcccttcaatgatgcatgtctgactgtagatgtcaccaacagatgtctggggagttacatcctacccagaatatgctctcctgcagtttcaagagtgagactgtgtgtctttattcatcctctgctgctgggctagtgggttttgccagatatatgctgctgctgctttcttttatggaatttccttttttattttttctgcttatactcaacagatcatctctgagaaatcactttacaaatgactgagattatcagcacacagaaggctctctcactcacagcactgctaggtgcaatagacaaatgatatcagacgtgtttctgcaactaattttattcctgaagcatcttaggaaagaaaagctcaagcaagagactgacacagatgttgaatttttttttaaagcatctacaagcaacacacactatccaaatattttgttattttattttacttggactccgttttgttattaaagaaaggtttgaatgagtttgcaaaatgcatataatatataaagaggagcaaaaaaggataaagaaattcaactaaaaaataaagaaaattagattatccatttgtaaggatattgcaaaaatttgtacttaatcagatttggtgctatgccacctaatggccaaagcaaagaggaaaacatgatcagcctgagatgctgcccatctggagggggaaaggttaaactattagatcgcattcactttttcacaagaacttggggctacttctcacattttgtggtttagggtcaggaaggataattatcctgcaatgcttcagtcctaaataattgtcctgcctgaaatgccaattatacacctttgagaatggctgacttgcataattcgtagagcctaaaagttaaaaactcaagaataaaccagtaatttgggagaagcaccagcactaaaattagaaaatgaagtcctttttgagaccgcctaaaagggactcagtagtatagcaaacatcaagatgctctaacagatgtcagagggagatttctgtgatcattcctaccatcatccagagagaactgctgttttagagtctcatagttcgacccgtcccttaatgtggcagttcatcctgacaagtatgtttagctcagcctccctaattttttattccaactccacaaatgtaagctgagtactaggtagtgttctagactctaccctgacaccctgaaggttggaagattaaacaagaccctatgcttctctgaatgagatgattttgtaataaggtcatcgtctcctctaaagcaagttggaaaactgagaaactaaaactccatattctgtagtataactctcatataaacatacaaaccagtcttcaaggtaaaccaattgactgatcaggcaactcaaaataacaaaaagaagaaaagcatagcagcctaaaattaatggcatctcttgttccagtcaaggttcctttggttgccagctctacaaatctactctggctccctacagcaaaaaagaggtttattaggagattatcagaggcccactgagaatgcatgggaagctgaagccaataggaacagcactaggggattccccaaggagcccagtggtgatatccttaggtgttgcaagtaaaggttaagatccctcagtgtgttctttactggatcctgatcccaggctaggatccatttggccaagccaagcctaggtcacatgcccacatcctggctgccagggtctgggaagaagaggatctaccgtcagtgacttccacagtgtgaggcagacgatgtgtctaaccaataccacacccaacagaggatgtggacagcccaaaaccatgatgcttgtccctgatggagcacaggacacactgcccccaaaatatggcttcctggaaattgagaagacagcgtaagcagaaaggtcaccctcagacactgccccacctttttgtgtgaaagctagccataaaagaattttctgacctgcttcccctgaaagtaagttataaaaccctcatgcaacagatatcctgccttattcccagagaaaagaaacaaagacacagagatgccaagaagaatcttaacaaaaagcatccaaagtgatatgatttgcctccatgtccccacccaaatctcatcttgtagctcccattattcctacttttatgggaggaaccctgtgggagatgattgaatcatggaggcgagtctttcccatgctgttctcatgatagtgaatgggtctcatgagatctggtggtgttaaaaacgagagtttctcttcacaagctctctctttgcctgctgccatccacataagacgtgacttgctcctccttgccttccaccatgattgtgaggcctccccagccacatggaactgtaagtccaattaaaacctctttcttttgtaaattgcccagtctcaggtatgtctttattagcagtgtgaaaatggactaatacaccaagtttccccagttcaatattaaaccttacccccatctgttcaatcatatttctacacaactatccattctccatcaaacctaagcataaaaaggacagttttacccatttctttgggtcttcatttctgaaggttctcatgttagatacaatttaaataattctgttaggcttttctcttgttaatctttcttttgtaatatgggtatcagtcatgagccttgtgatggatgagagaaagatatgactttttctcccctcatccccaatacctactgatgtatgtctccactcattcaatcaccagatgtgtgctagacactgttctgagcactgaggatataagagggaataagccaaagttccttctctcctgacacttatattctagtgtgtgggtgggtaggaggtagacaatgaacaaatacatagataatgatgccagctgttgtggcttcaaggactatggatatagccaaaacaggggagggggaccaggagtgctgggggcctgctcttctacatagagtgattgtggaggagatcatgtggttatgtgggggaagaggtgaggagccaagattatgaaaggcattttagctcgcatgaaggactttgactctaattctaaataagataagaattctttagagagttttgatcaaaaaagtgtcctgatccaattaatatttcacttgggtaattttggctgctggattgagaattaacttttgaggtgcaagggaaaaagaggaggaactattgtcaaactcaggtctctctaccaactgcgatactacactgtggagtcagagagttcacaggtaaagggaaccctggaaaggctctagtctaacactatgaagaaactcagagatgtgaagggaacactgcagctctgggagggctaggcctcctgccttgtgcctgggctatcttcactaatttacaatgatgacagaagaagctttgtccctctttgtcccccaaggatagtggaccatggcttcctcatccaccgagatctcttggggatgaagaaactctgcccttgtcagacccctctctgcactgtgggatgagcatgccacggtgcagaagcttgggtggtggtactagacatcagtcactgtgcctctcccagccactgtctagccggaagaggtgacccttagtggccgccttttgtgatgcatgactttctccctcaatccccacctcagtcagaccctagatgacaggattaggggtggactcctgatccaaggcaatatacctgaggcctggccagggagctaagatgatgcgacccagcaggaagagatgaacacagccagtaggattccccttctggcatctgaactaagacataacaacagcaagaagttctcagcagtggggcctgaagctaaaagtaaacatagacatagagctcagttaggggttacggcaaacaagtgaggagagagaagacctgcagagaaaagaaaagaggacttgaaaatcacggtaccaatgaaggacacaggaaatggctcactcacactaatgccagagcacttgcaagaaaaatcacacactccttctgctcaaattcctagagttaccttgccctgaggcctggtggttctatttttttgtgaaaatgtgtatagatacagtggcatctgctcctaaatgtttaggctttagaaatatctacctctgctcagctagtctggctttcaggccaccaacaagaagatcacacctaagatagtaccatacattcctcttcttagacacccactcacctcccagctctgatgaggcctttttcctcatgtctctatatccagggcaagtttgtagacaatctcattttactccaatgatatgttgattgagatatagctatagtgactgacatctttgaaattctacgtgtgtattcctccattttcatatggctatgaagaaatgcccaagactgggtaattataaagaaaaagaggtttaatgaactcacaatttgatgcggctggggaggcctcacaatcatggtggaaagtgaaggaggagcaaaggcacatcttacatggtggcagggaagacagcacgtgtgagggaactcccctttacaaaactctcaggtctcgcgagacttattcactatcgtgagaacagcatgtgaagaaaaccacccccatgatacaattacctcctaccgggtccctcccatgacacgtggggattatgggagctacaattcaaggtaagatttgggtgaggacacagccaaaccatatcattctgcccctggcccctcccaaatatcatgtcctcacatttcaaaatcaatcacaccttcccaacagtcccccaaagtcttaactcatttcagccttaactcaaaatgtccaaagtctcatatgagacaagctaagtcgcttctgcctatagcctgtaaaatagaaagcaagttaatttcttcctagatacaatggggatacaggctttgggtaaatgcagccattccaaatgggagaaattggccaaaacaaaggggctacaggccccatgcaagtccaaaatccagctgggcaggcaaattaaagctccaaaatgatctcctttgactccatgtctcgcatcttggtcacgctgatgcaagagttgggttcccatggtcttgggcagctctgcccctgtggctttgcagggtacagccccactcctggctgctttcatgggctggcattgagtgtctgtggcttttccaggtacatggtgaaagctgtcagtggatctaccattctggggtctggatgatggtgtccctcttctcactgctccactggggagtgccctagtggggattctgtgtaggggctcccccttcacatttcccttccacactgccctaacagatgttctccatgagggctctgcccctgcagcacacctctgcctagacatccaggtatttccatacatcctctgaaatctaggcggaggttcccaaacctcagtgcttgacttctgtatacctgtgggcccaacaccatgtgtaagccaccaaagtttggggcttgcaccctctgaagcaatggcctgagctgtatgttggccccttttagccactgctgggacacagggcaccaaatcccaagactgcacaaagcagcaaggccttggacctggcccatgaaaccattttttcctcctaggcctcctggcttgtgatgggaagggctgccttgaagttcactgacatgccctagacatgttccccattgtcttggcgattaacatgtggctcctcattacctttgcaaatttctgccgccagcttgaatttctcctcagaaaatggggttttcccataaaagccctagaagaaaacctaggcaataccattcaggacataggcatggacaaagacttcatgactaaaacatcaaaagcaatggcaacaaaagccaaaattgacaaatgggatctaattaaataaagagcttctgcacagcaaaagaaactaccatcagagtgaacaggcaacctacagaatgggagaaaatttttacaatctacccatctgacaaagggctaatatccagaatctacaaagaacttaaacaaatttacaagaagaaaatcaaacaaccccatcaaaaagtgggcaaaggatatgaacagacacttctcaaaagaagacatttaggcagccgcaagacacatgaaaaaatgttcatcatcactggccatcagagaaatgcaaatcaaaaccacaatgagataccatctcacaccagttagaatggcaatcattaaaaagtcaggaaacaacaggtgctggagaggatgtggagaaataggaacacttttacactattggtgggactgtgaactagttcagccattttggaagacagtgtggcgattcctcagggatctagaactagaaataccatttgacccagccatcccattactggtatatacccgaaggattataaaacatgctgctatgaagacacatgcacacatatgtttactgcagcactgttcacaatagcaaagacttggaaccaacccgaatgtccatcaatgatagactggattaagaaaatatggcacatatacaccatgcaatactatgcaatcataaaaaaggatgagttcatgtcctttgtaggaacatggatgaagctggaaaccatcattctgagcaaactaccacaaagacagaaaaccaaactctccatgttctcactcataggtgggaattgaacaatgagaacacttggacacagggtggggaacatcacacgccagggtctgtcgtggggttgggggagggggagggatagcattaggagatatacctaatgtaaatgacgagttaatgggtgcagcacaccaacatggcacatgtatacatatgtaacaaaccggcacactgtgcacatgtaccctagaacttaaagtataataaaaaaattaaaaataaataaaaagaaaatgggtttttcttttctatcacatatcaggctgcaaaatttttgaactcttatgctctgcttcccttttaaatataagttccaactccagaccaaatctttgtgaatcaataaaactgaatgcttttatgaacaaccaagacacatcttgaatgctttgcttcttagaaatttcttctatcagataccctaaatcacctctcaagttcaaagttccacaggtctctagggcagggtcaatatgccactagtctctttgctaaagcacaacaagagtcacttttgctccagttcccaacatgttcctcatctccatctgagaccacctcagcctggactttattttccatatcactatcagcattttggtcaaagccactcaacaagtctctaggaagttccagactttcccacatcgtcctgtcttcggagccctccaagtctttaggaagtttagactttctcacattttcctatcttctgagccctctaaactgctccaacctttacctgcccagttccaaagtcactttcacattttcacatatctttacaacagtacccaactctactagcaccaatttattgtattagtccattctcacactgctaataaagacataccctagactgggttatttataaaggaaagaggtttaattgactcacagttccacaaggattaggaggcctcaaggcacttacaatcatggcagaaggggaagcaaacatgtccttcttcatatggcagcaggaaggagaagaatgagagcaaaatggggaaaagctgcttataaaaccatcagatctcatgatacttattcactatcatgagaacaacatgaaaaaaaacctatccccatgatttgattttctccaactaggtccctcccatgacacatggggattatgggaactacaatttaagatgagatttggatggggacacagccaaatcatataagcatatattgtttatttaaaaccggccagacatggtggctcatgcctgtaatcccagcactttgggaggctgaggcaggtggatcacctgaggtcaggagttcaagaccagcttgtccaacatggtgaaaccccatctctactaaaaacacaaaaattagctgggcatggtggcggatgcctgtaatcccagctactcagaaggctgaggcaggagaatcacttcagcccaggaggcggaggatgcagagagctgagatcacgccattgcactccagcccgagcaacaagagtgaaactctgtcttaaaaaataaacaaaaaataaaaataaaggctattttttaaaaagctatgttgatgatattgcaagtccatcaacaatgtctaaccaagaggtctggacagctcttctgctggactaatagtttacttgacttgcagaattaaatgccaagggatcatacattcttactgtcttgtgtaaagcataattaggaagataagattacatgttaaggggtagaaaaatttttccttgggttactgaactgatcatttcacctccaccattaaaacaagtgttccttccggtggtttgcatggctggtcataagcaggtctccaggtctcagggacacactctcattgttatcgatgatgtagatcttctaagctgagtatttataaaatttgtcagtaaaaccactgaggatcaggactttgagattcagcttactgaatggtcccatctttaaaattctcacataagtgcccctgccaaacaaatgaaggattctaagcagcagggtctggcgggaaaaataggctattgcctatggcagaggcattgtcttagtttgggttcctaagaagcagagtctgagatggggattcttgaaaaagtagtttattaggggagtgggcttgggagaaagggagcaaaaaagctgaatggggctccgaagaaagttaaacgaagatgtggctcaggtggctccagtgtgatcccacagggagccctggaatacaaattacaccacagaggtggtcctatcttcaggcaaggtaccatttttttgtaccccttgttagtcattggccttcagagggaggtgaggagatgggtatataacctctagattgaagcagcttccatctgactagaggcaattctctgcagaagagggcgccatgagctattagcagccaatacagccctagatcacaggaggcaccagcctggtaagggaggtctgggctgggcacctcagaagttgccctgaatgattgtgcaagaatcagtggtgaccattgttactaaagaggaaaacatctctggtactggagccacatcaggttttgggtttatggtttcgtttttgttttcatttatgaacttgggcccctgtactaggtcaaattgtgggttaccgaaagacatgtccacatcctaaacaccagaggctatgaatgtagccttattggtaacagggttttagaagacataattaggtgaaggatctcaagatgagatcaccctggattatctgcttgggccctaaatctaatggcaaatgtccttataagaaacagaagacacagacacagaggtgacagccatgtgaaggtgcagaccatgcagccagaatccaagggaggcctggagccaccagaagcaggaggagacaagggatagaatttttccctagagcatctggaggaacaaatggtctctctctgtcacccaggctggaatgcagtggcactatcttggctcactgcagcctcgacttcctgggatgaatggatcccccaacctcagcctcccaagtagctgggactacaggcatgagacaccatgcctggctgatttttgtattttttgttgagacagggtttcaccatcttgcacaagcagttctcgaactcctgggctcaagcgatcctccagcctcagcctcccaaagtgctgggaatacaggcgtgaaccaccatgcccagcccaagcatgaagtttttaagaaactataactacaacagcactctttatcttatttatactttttaaggaaactataaactttttatactttttattgaagtatatacttttcacatatattcaaatatgcacatatcattaggatagagcttgatacattttcacaactgaacacaatcatgtaaccagcacccagatccaaaacggaacattaccagcacctcagaaacttccatgtactcttttctcggtcactactctcccacaagaaaaaccataatgctgatgtctaatcacataggttaactttgcatatcttcaaactttatataaaggtaatcatacagtatatattcttttatgtgtgtcttcttttgtgccacatagtgttggtcagatttatccataatgttgcatgtaatgaactgctcagcatcattgttgtatagtatttgatttggggaatatctcatagtagatccattcattctactaataatggacatttgggttgtcaatttttagctattacaaatagtgctgctataaaaattctagtttatagcttttggcaaacatacatatagaataatctggggaaaattgatatctctacagtactaaatcttccaaaatatgaacaacgtacatttatttaagtctttttaaaatttctctcaatattgttttgtagtctttgttgaacactggcacatttttcattagatttattccttagtgttttatatttttgatgctattataaattgcactgggactctgtgggattttaaggagatggaacattttagcagcctgagctttattgcctttctagacaagaatcctaaaattttcttttattaaaatgataggaggagaaagattatttaaatatcccaaactattaaaactgacaaaagggaaaacaaataagaccagaggctgcaattagccaattagagtgccaactacaaattccagttttcacttccaacagtatcaaataggccccaagaaaccttttcccagaaaaggatccaaaagaaataagttgaaattccatggtttgtgtaaaagaaataaactctttttcattgatctctggccagagagtgagtactttttctaatttcaaaaatttgaaagggagacaaaatccaatatttatacatacatattatgtgtcaagtgcattttacacaattatctatcatgacaaacctacacactgtttgcatttattcaattttctagttgaggaatctgaaatccaagagattaatgccccaaatcatactctatcagtgatagaaatgcaaattcaggcctgacagatgccagcagcaaccccgcacccccatctttagaagtaacatgaattggtatcttttcaactattaaaattaaagtcatgttcattacagaaattttgaaaaatatagaaaagtataaagaaatgattttatagatatacattgattttctactcagtatcacttataatatcctcacgagtttatatactcttgaactttatcattctaacatctgcatactttttcatcagttaatacactgtaatatttaaaccaaatacctttcatgttggacatataaaactattactatttttcatgtaatacatgactctgcaatgaaccttgcatctgtatcattgcaactttgcacacacctctgattatttctttatgataaattcctccaagtattatcctgagtcaaagggatagaaacatgttaagactgttaatacacatggtcaaatcctcctcttcccttccctcccatctcccagataagtcacagcttcttcctatccttagcaagagagagggccatctgctgtgtctttgtctgtgctggatattaccacttagaaaaatatttcccaatcggataggtcgaaaaaatcatattttaatttacacttctttaaataccagtggttttgagcatctagttattggccatgtgtatttgtccatttggatgttgccgtttctcaacaaatgctctctggatcacttgcattagaatgcttatgtgcataggaaacaggtcgattcctgattcccagttcagactacctaaagtgatccctgcatgggggttggagggaggaaatctgattttgttagctctgctggcaattcgtatggactctagattttgatcatcactgtcctcctccagtcgggcctctgcagattccagacctagaagcagcaaacaagtctacatgttagcagtggaagagactcgaattaccccgagttatggccggaatatccatacgggtcagtagcaacttcagtccttgcctcttcagaagaaataattcaactgaggggcataaagcagaaaaagagactgaagcaagttccagagcaagaatggaagtctattttaaaagacgttagaacaggaaagaaaggaaaattcacttggaagagacccagtgggcacctgaaggtccaagggagaaaagagaaaaaaaaaggggggggggggctttaatcttgatcctacaactttataggctcgcctctttcccacgaaaggtgtaggattcccgcatgcgcaatgcttttcttgccctctggaattgagcaggcagcgtgtttagggagttatacgcatgcccatctgaggcattttcctttttccggtggcatgtgttcccggaatgtcatacttcaccattttgtctcttaacatgcgtgcccaaaaagctgcttttccctgggttctacattcaatgaacatttttaatgttaacaggtgtggaccatcagtggcttgactctccgtggctgccgaattatcatttctatagaggcaatgcgataattgccgaactatcactcgacatttctagtgggtgggggagagccccctcctgccccactcatgcctaactacctgtaacatacacagccacggacttgatccctttataagtcaaaatcactggtgatcctcacatgaagcttttgtttgtctatataattcaaatgtgttttcaggtatttttttttttaaagagatggggtttcactctgttgcctagactggagtgcagtggtgtgatcatagctcacagcaggctcgaactcctaggctcaagcaatcctccagcctcaacctcccgagtagctggaactacaggcaggcacaaccatgcgcagctcaggtacattatcttaataactgcagagaaatctctgagatgtcatagttcaacccctcatttagccatgtcaataagcttaaaacacatttttttttgtggtatagtcaagccaatgactaaagattcaacatctctgcccagcaggattctaactacatagcaaaagaagagatttttttaaagagaataaaatttttattttgaaaagtttaagaaatcctgcaagagctgtgaaactagtagagtttcacaagtagagaaccaagcacaataaagcaccattcaatcctggatttcaaggagccagatgaaaagcctagtagggtggggtcctcagcctctcctatcttacttcccttcactgattaggccctagcaaatagaaacaaaaggattgttttcctgaggacagcatgtacatgtttaaagacattcagcttctgtaaatgccttacagggaattttaaggacataaaagctacaatgatattgtttgagaagctgcttttttcttatgcctttgcaattcaagcaagccaaatataattctattagcagtttttaaatgttaagtgtaaggattacctaatatttactaccagcaggccaaaatgacgcaaacaataggccagagctagcagggtgggcaggaggtggcacgtcatattcatgtgaggaaacctcttcccaaggaaataggtagaagcatccctgttaccgactgaatcatgctgccctccaaattcatgttgaagtcctaacatccaatgtgactgcatgtggaaatagggccttatattagtctgagtgctccagagaaacagaaccaataggatgtatatataatatgtagaaagaggtttattataaggagttggcttgtgtgattatgaaggttggcaagacattgatatgcagagtgaatcggcaagctggagaccaaggaaggcaatttaattctagtccaaggctgaaggcctagaaccaggatgaactgatgtttcagtatgagtctgaaagcaggaaaaaagctgatgtttcaattccaaggcatcaagcaggaagaatgctcttctacttgagggagggacaggctttttgttctacttaggcctttaactcataggatgagggccactgatatcagagagggcaagctgctttactccatctaccaatttaaatgttaatctcatccaaagtcacctcacaaatgtacccagaatgtttgaccaaatttctgggtccagtcaagttgacatacaaaattaactatcacaagaaaagtaaggttcaaacattacgatcataagggtggggccctaattctatatgactggtgtctatataagaaggggagactgggacacacagagagacaccaaggaagggcatgcacagagggaagtccatttgaggacacagcaagcaagtggccatcagcaagccaaggagagaggctcaggagaaaccaaacctgccaacaccttgatcttggacttccagcctccagaactgtgagaaataaatttctgttgtttaagacacccagactgtggtattttgttatgacagcctgagcagactaacacagtccccttcccaggaaggaagagaaaacagctttcctgttgcaaatcatcatatatgaagaacttatgcctgcactgagctatgcatttttcacccactgctctcatttatccttatgacactgtccagaggtgggtgcgcatatctttgtatcagttaggaataggtttggttgcacataatagaaaatccaagctaccatggcttgaccaaatgaaggcttatttttctcatattcaataactacagaagaaagcagaccagggctatgaggcagctcagggagatgatgtggcagctgtcacatccaggctccatcaagcttctgctgtttagctatccttcatgcatggcttttgttctttgcttatttccttgtactaacaagaatataactccatatctggcattcaggtaggaagaatagtaaggatgatgagcaaaaggcacaggacaactcagtttctcttttaaaaaaggttttacagaaaagcagaactcctgtttacagttcattagattgctctatgttatgctgcaagggggggctgagatctgtcattttagcagaatagaactgagggagaaggagagaatgactactggcaggcaacagcagtgtttgccaccttccccttgcacggatgagtatggataaattatacatgtcagttgctatttaaatcatgacacttggggaaggggatgctattgataataatgccaggacagcaggcacaaaacaggactctcctgaacaaagtgtttggatgcactacagaggaggccgagaaaggatgcttaacttgtccaaggacacattgaggattccaaccctactaactcttaccccaacactcatcctccttaacaattgcactagaatgttatgattataaggatgtagatgtagattatttgcttcagaaacactaaagtgcttgctaaaaatactgattccttgaccctaccccagggctttggattcagtgagtctagagtagaggcccggaggtctgcttcctaaataaacatgccagggtaagtctgatgcagtgagctgcattccgggaaacattgttttaagacaaccaaacctgtataaataagcacaaatcctccaccatgctttcactaggagaaaaatgacatttattcaacttctgtgactcagcagtttaaaaggacaatgggacatttcttgcaggacctggtcctcctgataaggactagccattacctagggaatctgggaaccaggcaaacattcatctcattggggagagcaaaggtgaacagacccatgggaggctgcgggagggtcatagcagcccaatggccagaggtgtgtctctcctcactcctgcccaggtaacttttatatgctgagcctatcaactcccctggggtgaggtggggtgggttgcaggaaaccagctctattctgataaccacagaacaaaagggttggtagcctctagaaaaaatacccaaataagacagagcaagtatagacttttcactcatacaacgaacagttttttaacacctactctgtgtcagattcctagtgctagggatatgttgatgagaaaatacacaaaatacgtgccttcgcagagctttcagttgagcaatgagggaaatcctacaccaaagaacctcactggtgaatgcatacttaacacattgcctctgttgatctgaaggaagcctccagagctacaagcccttacagagtgccaaaaccacctctccatctcttccagttaattcttcagtctcagttcataacatgctcccttagtccaggtcaaactccctgatattggctgatactcaaatttctgttaaatgcacatatgaagaaataaatgctctaagtccatttattacaaagttttctcaatttttacacatattgattgcaaggtatacaaacaatttgataacactttctcttttttttggttgggagtgggaagggaggagttaggaaaaaaacacacacacacacattaaaatttccagaccatacgatgcatctaaatttcatgagtttgaaaatacagagagaaatgagttttagaaacaaggaaaagcagtacttagtgacttgcaaccatcatctgctcatcacctgggcaggggcaggggagtatacattagtacatcagtattttctgcatctgcctgtaggaacctcaaggccagggaaggtcagacttggtgtaatgcaagggttcatatggcagtttgtattttccaaagcctctcattcctcatgttcttcttataaggtggcatcaacactcctcctaccaagaagtaaagtctgttccctcctcttgcatctagaggatgagtgcatgccgggggtgcgggaggtggggtagtgggagaggagggaatgggtaacttctccaaactatagaatacagtggaaagggccaggtgcggtgactcatgcctgtaatcccaacatcttgggaggctaaggcaggtggatcatttgaggccaggagtttgagaccagcctggccaatatggcgaaaacctatctctactaaaaatacaaaaaattagcaaagcatggtggcacatgcctgtttggaaggctgatgcacaagaatcacttgaacctggaaggcggaggttgcagtgagcagagattgtgccactgatggagtgagactctgtctcaaaaaaaaaaaaaaaaaaaaaagaatgcaatggaagagacacaatgcaacttcccaggctacgttacctctctgcctagctctggctgtctcctaggatgctcatcctcagtacagttcagctgccatgttggcaggaagcacaggccacatgaagaggtcatatgtaggtgttccagctgacagcatcagagaatgtctcaactgacagccggcatcaaccaccagacaagtccctgagtcagagccttcagataattccagccactagatttcagtggctggaattatcttcagccactgaagataattcagtcaccccagctgacattaagtgatgcaggcaacctgtccctacagagccctgagcaatttgtagatctgtgagcaaaacataggtcatcattagttcaaatcactaagtttagggggcagtttgtgatacagccatagtaactgaaacagcatgcaaatgcttactgcttctttcttagcaataaccacagaaacatggtaacagttaagttttatgtcctgctttagagtttgcttcttgcactctttcatttcaccaataaattattgtaatcacctccacctcacatgcaagaaaattgagacacagaaagacaaagcaatttgtccacagtcataccttcttctccatgggaacaagacaagggttaccggagttattaagaggaattaaaggagtgcagttttgaatgccggctcttccccgtttcttgctgcctgccttcggataagtcattaacctctctgagtctcggttctctcattgtgaaatgcagatgaaaatagtaccactttgtggaatttttattcaatgtttaactacacaagcagcactgaagacaaagtcaggcccagagtcaggcgctcttttgtcttgtgtctccagcagcacggggcctttgacagggctggcactccatgaacatttcctggatgaatgaacaaatgaattgaactcccatccactaggccccaaaatgcctcctcctgttatatcaggatgccacacttagggcttataactagcagggttgattttccttggcaaatactaaatggaaactgtgtactgggttggcacagaatggaaaaattggaattttttcctacgcttctatgaatctcccattcatagaagcattcaaaaattcagaatttaaacacacagccacacacacattgtagcatcacacagtgctcataaatcagggctgggatgcgcactccttaaggactattgccccaaccctggctgagctcttgccctctgagccacaacagtggcttacaggtctcttcgccctgcacccaaccccaacacaaacccaccacttccccagctcggcagagtggcactagctattctctgctgaaaacaaggaacagaaatcaatttcgttctagccatactgagtgcagcaagcaggataaggctgaactctgtcaaaccaacaatgtagaaaacccgatttaatactaagatggacccaattctctgacaggcgtgttaaatgtgattaaagctgcacagcattccctgcatacccatctgccatgttgaggagcccacagctgttctgatttctgatgtacagtttcttgtcagttgtttcaaatgtatctcatcttgcctgtaatctgggctctccctcccttgcccctcttcaggccagccttggccagcttctctaagcagttgctgatatccacatgcctttggccgcgggtctgtagaggcatgtgtgagctctggctggtgcaaaatgtgtgatcacagagaaagcttagcgctttagcggctggaatgagtctcttggatcctaagctgttgtgacgccaccacctgcagctcctgcaggtttttgctgcagggtgaggggaaagagcagggacaaatcgtttttgatgctacagagagctgtgcctgagatgcctacatgctaccatggaaatacaatctgaaagctgtggaagtccagtgcaggcatactttggggttgtggagaaaggcagaggcagaaatggaagtggggttcttctgggcaagggatggagtcctcagaggccattgcaaccttgtgcccaggaggcacagataaggtagaggacagctgatttcaagaggactggaccacctagcattgacccatatggcatcttcatgagaattttttaaaagttggagctatggccctgcaccaaggtacacaacctggcaagcagggcataggctggatttcagccccactcaccctcttgaccaggggtccttgtgcaataaacaacatgtacaaccacacatatcaacaatgaacagaggaagagctccaaggagcatacggaagtcatgatgagaagtagggggacaaaataagtgaaaaatgcctgcccttaagcaactgagagcaagcaaggctagcaatatggacgtggaaaacacaggagagcataagagaagggccaggagagaaatagaaaaacagagtgccaagggattcaaagaggagaacatgcttctggttggggaaatcaagaaaggcttgcagagagagatggcatttgaaatgaaaaggagaaaggtacacaaagacacttcaaacagagaggcatgaacaaagaaatggcagaggggagatcagggccatgtaatgggacagtccatagtccaatttgtctggagctttaagtggatgcaagagatgacatctcacatctccctcgggctccacacaagaaggatgctatggcagacaccttataaatggagaatgaggctctgaccctgactccctctccatgtgtctctggccagcccatcttcacccttatgatgaccccccaccacttgtgcatttgctcatcgtggcctccactgtgccatcaccttcttgttttgtttcctggacgctggagcactaaaataatttggggatatattatagaggatcttgaatgacaactatggaggatcttgaacgtaacaaagatgtggactttgtagcagatctagggatcaagaagagccactggccatttttgacatgattcatggtcaaagcaacatgatcagaatgcacctaggaaaatcaccctgtggtggaaggactggagaggaacaaggcaggatgctatgctctgggtggggaaaatggagggagtgaagggggcaggaaggaaaagcagggccatttcaaaagccaatatggagactagaaagggtgtcaggtggaaaattgggtcaaatcattgaattgtcagaattaagtcctgccagcctgcactggactcctggatgcaaaggctggggtgttgtgtttctacacacccaaccgcaacacagcagagggtactgacacgatgctggagccagccaatcaaaaaacgacttgcttgtgcagggggaaactgactgcagtacctctgtctcccagatagttggtgtcttcctggggaatgatacaatgggaataacagaaatgaagtcatcagactggaatgttattacagaatcaatcactttcatggaaatctttattccactaatagtctcgttttaagtataagattttatctgtttagaaagaaatgtaggagagggaaaaaagaaggtgaagagaagagtagggagaaaagatgaggtaagtcacatatacgccttcttaagtctccaattcacttgagaacttaaagtcataataaatagttcagaaacacaaacatactgattctcccttagctatctgtattgacgtgctggggctgctgtaacaaagtaccacaaactgggtggcttcagcaacagaaattcgttgtcttacggttctgttttttgtttcgttttgtttttgggatagtatctcgttctgtcactcaggttggagtgcaatggcacaaacagctcactgcaaccttgacctcctgggctcaagtgatcctttcacttcactgggccacaggcatgcaccaccaagcccaggtaattcctttattttttgtagagatggggtctccccaccttgcccaggctagtctcaaactcctgggctcaagcaatcctcctgccttggcctcccaaatcccaaagggattataggcataggccaccacacctggccctgtctcacagttatggaggctggaagttcaaaatcaagggatcagcagggccaggccttctcagaaacctgtaagggaaaccttccttgcctcttcccagcttctggtggtttgctggcaatctttggcgttccttggcttgtcactgcataacatcaatctctgccttgatcttcacatggcatttcccctgtgtgtctctcctgactcttcttataaggacattagtcatattggattagggaccagtcctactcttgtataaactcttcttaaataattacatcgacaccaactctatttgcaaataatatcaagttctgagacactagggattaggacttcaacatatctttttaaggggacacaactcaacacctaacactcccacatttccctgttccttctcccagaaaggtagggttggctcccaaagagggcctcatctaagagattccttccctgacctctctcatctcttcacacctaggtttccactctaggaatttctcagggaggcagagtggatttggtgtcattgtagggaacccctatgactggtccttggggtcaaatcctaactgcaagattggctggctgtggccaaaaaagcccaggggctcatttggatcctcccctaccttgaggtattcctaaggaagcactgttattaccaccctcactctggtcaaaggggatggcagagccttcttggccttctggctcaagtatgcacatacccttcactgggcggggtttctgcacaaatacacaagtattatctttgctcatctcctatgatctatgacactcactatgaaactccagaggttgtcaagaataccatcccttccccaacccttctattttctgttgtcaatttgctttctacaaggggtcctcctagagatatttgaagacatttatttagtacaatgtccactcccacccccttagtcctttcttcagcagagatcagtccatttaacttcacatagtaagccaaccaagtcctcaggctccacacaagaaggatgctatggcagacaccctgagcctggacaatgaggccctgactcccattccgtgtatctctggccagcccatctttaccctgacaaggacccccactgcttgtacatttgctcatcatgacctccactgcgccatcttttctcctagaccatcatcttcttgttttgtttcctggactttgaagcaccagcttccctcctggaatggcacatcagcagcctgctaccccaggcacagccacaccctgtagtgcagtacagatcccatatctgtaggctgcaccctgctggcctagtctcccatggaccctctttcctgaatgcagagaagccatgagaatgagtcaggcacaacccaaccctgccacatttctccacgtgactgctcatcacggtgacaatggtaatattggaatacctcccgccctaggaaggaattatttcaaaggggctgattgttgcttcccaactccccatgaggcaagctcgttagcttgctccactcaactaaccagcctgggcagagctgctgctgcattttaggaaacgtggcattctttcttgtctcagaaataattcaaactcttccctcaaagccccagttcttcagttctgctgactcaatgctttcttaagatacatgttgaaaatgacaactctgtattagagaaaaacttgagtataggcccttcagttcttttaaagacatcagaaatcacttagtgatttccttaaagaagaaaccagtactaattgaaaatgaagttggtttaattcaataaatatttgctggcaaatatgatatttcaggcacaaaagacaaaagagaaataaggcaccatcctcaacctcacaagtgcacgttggtgacagaagcacagtacaaatggccacccaacattggtataacatcaaaggtcatgttcctacaagcctgagctcttcctttcccaaacctcaggtcacatttgtaccactctactcagatactggcaaaactcaaattgtcatttactaagcacacccattttagatcaggtataaataaataaataaataataagataaaaccacaaaacatatctgtatctgtgcatatgtgtatatatgtatatatatatatatatacacacacacatacacacacacacacacatacacagtgtgtattgcaacctcaagagatacagtcacaaatgccacaatccagaatgtcaaaatccctaaagatcaaaatccctaaagtctaaaattcctaacatctaaaatccctaatctctaaaatccccaaaatcacaatcctgaaagattaaaataccaaatgttgaaatcttgaaagcagaatcctaggggagagattagtatattttcagttgtacacagagctgcatcatattagtttcatcatcttaggcaaactattaccttgttagtgtctttgtttagaaattaagtatagtttaagggtgccaagtggacaaggagtggatttgtggacttaattttaagtactaacttgacagaattaaggaatacctagaaacctggtaaatcattattctgggtgtgtctgtgagggtgtttccagagattagtgtgtgagtgtgaatgaactaggcaggaagatgtgccctcagtgttggcaggcactgtctaatcagccaaaggccctgaacaaacagatacagaaggtgaactggtcttccactgaagctgagagaaatatttcttctgctgctttggacatcagaaattcaggctctgagctctgggacttacaccagtggcactctgggtcctgaggcttttgaccttggacagagagttacaccatctgctttctaggttctaaggcttttgaacttgcacagagccacactgccagcatcccagggtctccagcttacaggttgcctatcatggaacttctcagcctccataactgcgtgagacaattccccagtaaatcccttcttatatatctaaatctatatccttttggttctatctctctggagaaccctgactaatataaattttgtattggggaaatcagatattgttctttcttactgcattccttacaacataatggaagagatctgtgaaagttgttccctctaatttaattgtgtgaggctacttaatggtgaaagataaaagtttaaaactaattattactggtgctgcaaaagcagaaaatcacctaattgcaatagccaagcaatatccagactctcagatggacggcatatacttacgaaatgtatagaccacaactattctccaaataaaagtgcagcgagtgtttccaaactcaaagatgtgaaaacaaatgaaaaacacaagaaatctcccctgccaaattattctattgtatacaacttctgccccttcacacatagtgccaattggctatgctatgagttttatctttgcatcatttctagtactggtgatataaattgcacaaagacttttagagagctctaattcattttagacattttttataaaaaatggacaccaagaaagtgctttattcacaatgttgactttgtgtgtaagcactatgcatgtatgtaaaaaatgttgaaacttcctcagtaaatgaagatgtaaagaatttatctttcacaatgcagatgtacaaaaaggacctctctttgcacatctgcatttgtgaaagatatgatttcttgaagtcccaattcttcgggtgactgcatatgcagtggtgacccactgtggtttttgtttgctctcgtcaaaagattgaggttgcccatcatggtatttcagatgaccacagttataaagctgggtgtacagaattgccaatcatagtggtatgcatttataaatttcactttctgacctatttcttcatgtatacagttcataactgttatgctctcatgactgttgttagtacacctgactgtttatgcttgcaaaaatatgcacgttattattaactagtctgttctgtaaagcagtctatgaagtatgctgtcattcttttatgcttctcaaataaatcccccttttaaaatgtaaatacatttattttaaagaatttttattttttccagaattatattttggggattttggactaggaattttgatcttttggggtttcaacattcaggattatggtgtttggaattgtgtcctttggtattatgacctaaacccaccaacaagtgggagagcaaggattcaaacccaggtctgtcccattccaaagaacatcctcatgaccaatgtgccagtcagactgtccaggtgctactgtgctccaggaaaacctgaagggaaggttacagattgagcctcaaaatccaggttaggacccaaacctggatcagcatcatccattttacacattaaccctgatgaaggagagaaactagacctgaagaccaaagaagcagattccaggggtcagggtgaggtggccaacaggaaacgaggctgcagtttgaaggccaaggggatggaaaccaggggaaggtgggatgggaggaaggaatataaactggccctgaagaagggtttggcacgtggactgtaaatgaggaaagggtctcactctgattagtcactggccagatgggtggacccacctgcctcagggacagtgacaagtctgggacagacccatggcaatggcagcccccacctaggcagctgccagaaatcctgtgcagagtccagcactgctgactctgtcgtgtgacagctctcagatgcaacacgggtggatccgtgggcgcttccttgaggaggctgagcacagtccaaataatgcacagcagactttgatggccctcccaaccaaacctttttaggttacagacagtgctgtgtttatactcccagggacggaacatcctttgctcacagccccacgctccacccccacccaccatctccccaactttggcaaatgcctagactctgagcaatctgtgcagacatgttgtgaatcactgtcagttcaagtacacaatattccctgattttaaccctccttggctggcttgccttgcatgctcccactccaagcactggtggaggcaaactccataaggaagcagcacccccagggctgtatggagcaggcagcagggagcaacagcaggcaggacagccacagaactaggtgactgatacccatgaagctcagacagtgccaggcacagtcccagagactttacattcccacagatctgtgagcaagtgattattatgtccattgtgagtgtgaggaaattgaggttcagaaagattaattttcttttttatttttttgagatggagtcttactcttgccacccaggctggagtgcagcagagctatctcggctcactgtacctccaccttccaggttcaagcgattctcctgccttggcctcccaagtagccaggattacaggcacgcgccaccatgcccagctaatttttatatttttagtagagacggggtttcatcacgttggcctggctggtcttgaactcctgacctcaggtgatcggcctgcctcggcctcccaaagtgctgggattacaggcgtgagccaccgcacccggtccagaaagactaattttcatacacactaaagtgagagagcttagatttaaaactagatacgttcttcctaatatacaatgttctatctcaaatcatcatgtttccaatgatttctattagcagccataatagtaatagcagcagcctgtgggctaaacactacactaagtgctttgtatgtactaagtcatttaatctttccaaacagcactgaggaagatacaactactatcttcattttagaaatgaggatctgaggcaagagagttgagcagcaggagagaggtaaaaaggtagtgagttatcccctatgctcttcatttcctttgcccttctccttactagagcccactcagctagttggggcagactgaggctcatatgactctaagttcttaatagctcatctacagacctgtgctgaacagggaggatcctagaggacatgcggccatggagggtctgagagatggtttgggggtcgggatgtatatacaacagtcccatagagtcattccccaaataaagcagagaaggacaatttgaggtcttgagataaataagcaagaatggctagatgggaaagcttggaggcttctgaagattcatagagagggagcaggagcaggcagggcaggcccattaaaggaataataaaaattagccctttcgtgcacacagccctgggtcccaggtcacaaaggatcttcacagatgtgaatacctattttatttagggattcaaaggttccatgtatgaggcaacatagcatgtgggaaaggagcttggggacatgaagaaggatagagctctcgagcaggtgggaatacactaagggtggtcccaagaagggctgttcatgccaagaagtggattgacaggctctggaatgaagtgaatccaggaagaagccaaagcagcatcaatcatttcctgccatgcttgtgatgcccatcgaacatgatcactcccttgagggggctccaatgtctcatttgggagtgactctaccccagtttgttactttggctatcattagccaggaaggggaggttccttatgaatccattggactgctgattcctgaagacccagagtgatccatgaaggactcaaggacaatcctctccctattccttacccccactactaggaccaaattcaggtttaacttgccttccctggtcacctactaggcactatgctaaatgcaattctaattttggagacaaagaaactcgttcagggagaaacttgctcgatgtcacagatatccataagtggcagagccaggatccaaacttggacctcttattccaagtgcattgctcttttcactacatcatgctgccttctagaaaaatcagctaactctgtgcttctagactctacacagtattcaataactctgatgactttgaattcaggaaatgtctatcaattggaccaggatctgctttttaagcttatctttatttctagtacttcctgagaaagagtaaagtattctgaaatatagaagatggataggtagaaaaatgcatatgtaaatacacagatgatggttggatagatgggcagacagacttttttaaaatttttatggatacatagtaggtatatatgtatttatggggtacatgaagtgttttgatacaggcatgccatgtatggtaattacatcttggaaaatggggtatctatccccttgagcatttatcctttgtgttaaaaacaatccaattatatcttttagttattggacagactttgagtttattggacagactttaattgagctcctccatcaaactttgtgactttgaaaaatagtcacttaggttttgtttgtttgttttctataaaatggccttgtcaaagcccttctcatggaactattgtgagaaactacctctaacagtgcctggtatacccatagactcttactattctcccctttgtgttaaaatcatgcttcagaattatgtccaaattctgcagcaaggacccaattcaaatattgtttgaaacatccagaatgtctgtttttgacatcaagttggcccatagatttgacagcctggtacccatagagtccccacccaagaacatttccttcaaaacaagctcctgttacagaaacggccctggttttaaatatactcccttctctcataaaaatgccccagccagctaaagtcattctatttaaaatatttaattaataccttcacagaggtctggaacttattaaagactcttggggaccatgtcttaggggcaatgctttgttctaagcagctctatgtgttacagataatataaagtgctggaatgtgctttctattaaaagcagggacatttgcctgcctgctgttgcaaacccttttgtcatcatcgtgacacattaaggcataatccaagtacaacatacacacacaaacagtgtcaatccatccattgagtaaaaagagtcccaggaaaaccacaagaaaggtctggtgattagatgaggggattaaaaactggaggagctcttcctctacctcttctcccacctgaagaggccacaaaggcacattgctccccaagcaaacaagagcaaaaacacaaaggcacacactttgctctacctccagtatcttcttggcttctcagcctttggcaggtgaaagaaacattggttaaaagtcctaccttccaagcaagtaaacatgctcttagtccccctttgtctcacaggctgaagactggcaattgcttcacatccattgttgtctggggagtacatttttttttcttattataaaaatggtataggttcaatcttgaaaaccttggaaaaaatgtaaaagaaaataattattttaaccataaccctaccacctagacatgactttgctgcatttctccccttctatgtgtatactttcacaaagctgtcattaccacacatttacccttttatttccagcttcttttcccttaaagacattgggggaaatgctcagggtatcatagtaagagatgaagactttaaaagaaattaaagccttttttttttttcaagcagttttaggtttacagcaaaattgagaggaaggtacagagatttccaatatactccatgcacccccacatgcagagcctcctccattatcaacatcccccaccagcgtggtacatttgttacaactgtcagccaatgttgacacatcataatcactcaaagtccatggtttacattagggttcactcttggtgttgtacattctgtgggtcagaacaaatgtattaatgacaggtatccactattatagtatcattcagagtactttcactgccctaaaacccctctgtactctgcctattcacctctccctcctcgctaaaccctggcaaccattggtctttttactgtcttcacagttttgccttttccggaatgtcatagagttggaatcatacactatatagactttacaactcacttctttcacttagtaatatgcatttaagtttcctcatggcttgacagctcatttacttttaacgctgaataatattccattgcatggacataccaccgtttatttatctattcacctatggaaagatatcctgtttccaagtttttggcaattctgaataaagctgctattaacatctgtgtgtaggtttttgtacaattttcagctcctttgggtagctaccaaggagctcagttgctgggctgtatggtaagcatatttttagttttgtaagaaactggcaaaccgtcttcccaaatggccatactgttatattttgcacccacaccagcaatcaatgagagctcctgttgcttcccatccttgtcagcatttagtgttgtcagtgttctgggctttggtcattctaataggtatgtaatggtatctcattgttttgatttgcatttccctaatgacagtgatgtggaacttcttttcatatgcttatttgccatctgtatatcttatgtggtgaggtgtctgttgagatctttggcttattttctaatcaggttattttcatattttggtgttgagttttttttatacttttcttttggatagcagtcctttatcagactgccttttgcaaatatattctcccagtctatggcttgtcttctcattctcttgactatgtctttcacagagcagaagtttttaattttaatgaagtctggcttatcaattatttctttcatggattgtgcctttggtggtgttgtcatttatttttaattgccaaggatgataccactgtggggctgaaccaacattaatataaccaattatttcccatatgatcaacattgaggttgagattttcactactgtaaacaatgcaatgacagcatattgataattgtgcactttttggattatttcctttggataaattcctaaaagagaaatggagtctcaatcttgttagagtatctgatatattttgctaaacttccatccccaaaagtaccactttaccctcttacctgcatgtgacaatatccatcttatcacacttttaaaaatattttttactaagatacatagatatatctgtattttttttctttaaaaaaaaggaaaaattcatcataaggctgctgccctttttcatgcatcacgggagtacagttactatccctcttcttaccattccatttacattaaaaaagaaccctgaggggaaacaggggcctccaaagggtacatccctcctcccacctgagtgaattgggagggaaaattgaaggtcttttacaaaatcctaacatggttgagagcaaggatttaaactttggcccctgtacttcagccaagatcttgtaagagtttatttatttttctctatttttccctttgataatcaacaaatttaacgtattcattttaaatcccacaagtctgttccctttcccaggagcagaatgaagtaatctagttcccacgttctgacagcatagtttaagggccacaaaagatgatagcccccagcccatacagccagggatacttccaataactggaggtttgccaaaacaatcaagcaagagacatttgcaccagagccttgaagatcgtccaacccttagctgcccaattattacctccttcaagagtagaagtctttcctccacctgactgtagccatatcttgaaatttaattgaactttgccaccagaagggttcattttatttttaatagagacacaggcaatgcttttcttaagtagggacaacctagcggcaaaacctcactgtgttcctagtctttgcatcttatctgaagctaacatgcagacagggcagggggctctcagctcagtgggtgctgtgcatcttatgctttggaggtttggatggggcaagacttgggaagaaagtaccttcagccttacggtccctaagtgacagtgaccacataaggtgtatccaagtccactgagaatctcagctacatttcatgacatagctataaaacagttccaagtactaattcgttagtcttgggttttatgctgagtgactctgaaatatctgattaaagaggctagcttcagtttccactctgaaaacctggcttgaatttattgctgcctcacacaggattgcctcaagctgggtctctccacttcagtggcaggcaggttaactatttcactgctggatgctctgtccctcactgccaacccacccccagcccccttcctaaactctcatcccacagccccgggagcggattctgcaaagggcttataaagcacagagggaaactgaccatctggcctgagtgatctttttttgaagggtaaagaagatatttagaaagagtccattgtaataaacacattttcaaaattgttttaaagtacttaaaaatacagagatagagataattttctgtttaaaaaaagacttttaacagccaaataattctcattggtattttatataaaacacatgcgtaagtttggaaagtttcaatcacacagaaaggtacaaagttaaaggtataaaaataatgtaaagcctactttacccatcagaataaacataaaacccagtatatgcttattcttataggtaaattactcttgatttaaatatgtacattttgtttgaattatgctgggtctccaggaacacaatccttatataaaatgagatagccctggactattttcacttctctattttatagaggaggaaaccaagctagagagagaagaaacaagtaacttgcctaaagtctcagggataataagcagcagagcaaggacatagtcctaggtgggatcccagagacacgtatgagctcacctgggtcacgacagtaactgcccagcaaccctactgccagtctcggtgtccaccagcccacaatgagtcttatgatcataccatgcctctatccaactacttaaatgactccccacttcatatacccacactggagagtggattggatatggaaaacaccatttagcacaaagttatttaaagacatgcatgttaaagaaagcggattctaccaaataggataatacctttttttttttttttttgagatggagtcttgctctgtcaccacgctggagtgcagtggcacaatctcgtctccctgcatctctgcctcgcaggttcaagtgattctcctgcctcagcctcctgagtagctgggattacaggtgtgtgctacaacgcctggctaatttttgtatttttagtagagatgaggtttcaccatgttggtcaggatggtctcgatctcctgacctcatgatcgaccccctcggcctcccaaagtgctgggattacaggcatgagccaccgcgcccagccgataataccattttaatagttaccaaggagtcagtgtagatgactacctatctgttaaaggctttataatagcaattaacatctttaaaagatgtaggtcaggaggtagcaataacagctgtcgtttttgtcttaaactcttcaaaatgggaggggaagggagactgatctctaagtaaataaaaatagttatccatattcagtatctagagtctagcagagactatgctaagtatttcacatacgtcagcatatttgagcatataactctgcgaagtcaatagcattatcccagtatatagatgaggacattgaggctccaagatgtcaagcaattaaccaagaccacccaatggcaagcggctgaattggtttgccagggttgccttaacaaagtaccatagactgggcagcttcaacaacagaaatgtatttctcacagtcccagaggctggaagtctggggtcaagttgtgggcagggttggtttcttcagaggcctctctccttgacttatagatggccatcttctccctctgccttcacgtggtcttttctctgtgtgtctgtgtcctttttttaaggatacctgtcattctggattagagcctactccaatgacttcggtttaaataactaacctctttaaagaccctatctccaaacacagtcacattattctgaggtactaggggttaagacttcaatgtatgaattggatagggacacaactcagcccacagcactgggtgagccaggattctgacacaactctgtgatgttggaagctaccccatgttgtgttggaattcagaatgattctttaactcctttggcctgttgcaatgagatttagaaaataaccacgaaattggcaacttctgtttacaatcactatagttcttttaacaatagtgaacaacaacaacaacaacaaaaaatgcaaggcaaggcccaaagcaaagcaattgatttgtctctaccacaggcaaatgtaagatgctgagcctttatatagctgtcttgcttaattttttcccaaaaggttccacaaatagagaaagacccaaaggcttctgcaaacctgtggctgagatttagctgcacattcttgcctggggctactatccacctccatctcctgcctgaggaccctctggcgggattaccagcccagagccagggaggtggcacatccactaattgggcagggccgtgttgggtgtctttgtgtcatcccatgaataatatcacagctacacccctttacagtccttaatgttattttctttttttgtttgtttttattttgagacggagtctcactctgtcacccaggctggagtgcagtggcgtgatcttggtccactgcaacctctgcctcctgggttcaagcgattctcccgcctcagcctcccaagtagctgggattacaggtgtatgccacttcacctggctaattttttgtatttttagtagagacggggtttcaccatgttggctaggctggtctcaaactcctgacctcaagtgatcctcccacctcagcctcccaaagtgctgggattacagatcttaatgttattttcttagactgactcatcttcatatcaccctcacaacttctaccatatctgcattcaccctgtaattttacctactatgttttaaatcatcttatgttttgtttacatcgatctttaaagggaaggtttatataattatcttaaatggaaaatctatatcatttgtcacagatagaaagtaaccataaaaaggtacacacaaaaaaacaattattattaaattctagctagttacagctgtttgccacctctttctctgcttttaaaaaaggggattgggacatgtaaatgaagtgtttgagatatagtagtcctgaagtgagactttcttataaattaatcagaagctgaaacaaacttgaagagagaataacttcttcactctgtgattagtattccctaatgctgcgactttgtcctcctgaaaaccaattccacccacatttgggaaaggctgctttctacttttcaaagcactttaacaacaaccctctaatataaccagagcagacattttacacttgtcctctaaatgagaaaattccagcaaattgtaggcattgtgagaaactcctaaactccaagcaagcttctcatttggcgtttagagttagacaactatacttggggtccaggaatgaggggtcggcaggaaatacttactgcttaaagagatgactttctatagttggctcggcccctttgttggtcttcagccaagtgctacacaactggaaaccaaatctaggctcagagacacatgctagacccaagtttccgggactcggtccctgaccagcttgcagaaggtgctgggataacatccgcttctcccagggaaggagggaccgcggctctctttgctcagctgcagcaattgatttgactacaagatttaccaggtccctctcatcctgcctttgttctgcaaatagctgatgcagttctcaaatcaaaggaacctctaagccctggctcttaaagggtggccaccagcagtacctgggagcttgtgagaaatgcacaatctcagcaccccaccccacaccacgacacgccccctgccccacaatagattaactgcacccttgaatccaaatctccaggttaacagtctccaggtgatttgcaatgcacattaaagttcaagaagcactactttaaaaaaattgtgatcaggtggtcatcctggactgcaagccgtggatccttcagctgtgtggtccttatgctcacagttgggagctaccactctaaatgttgcaaccacttggaacaccgttctaatccagggtcccctaattaccagctgtgggaactagggcagatcactcagccctttgcggcctctgtcagtgcatctgtaaaacaaggagagcaaactccttctcccagaagtatctggagtagcccttgagaatgtctatagggcactgcatgcagtgcctggcacacggtgagcggcacaaggtgctcagtcaacaaacatgcattgatgatctataatgcccggactctggggctacagcactgaaaagatggacaaggttggctggaaagaaataaagaatgaagaatttcagtagtgataaggatcctgaagaaaataaatcatgcaagcgagtaacaggaatggcagtaggtaccattggcagagtagtcagagatgctgggtctgaggaaatgacattcaagccaaggcccaaatcagggaaagacgcagccacatggagatctggaggcagaacattctggacagagggtacaccaggcagaggtgcaaaagccctgatctggaacaagcttgccagagaagaggacgagaaagaaaggtcaggatggctggcatataggtattataagacaaggctgccgagataggtggcttcatttctatcacatcataactcaccatcagcgctacagtcatccacatccaccattggctttagtcagaaagccattcatattctccccacgacagacggcagagagatttggagaccaagactgtgcctttgtgtcccagtgtccagcttcatggatgtttacctgcctgagttcctactgaggaaggaggcacttcagacccaacaccaagtgctttggagaaagaagcaagtctctcctctgcagggaagccacgtgctctggctagagggaattgatgtctcccagctggggtggattttctgctgattttacaaataagccagacgtggcaaatcctatgggaagccagcccaaagcagccagcaagatcagatttggagtcttcatcaaagggttaggtggtgctagctatgagccagacctggtggctccaaagttgcccttaaatatatcagccagaattcaaggaagttgtaggcagagggaaaacagctggcttgtctcagaggtttaaacctcgtttgcggtatcacaccatgctatgcattcaaaatcacagtttacaaataactgaggcttgcttctcacttgagcctaacaatcctgggaggcagggtaagtcttaccatccctcttttgcaatgagaattctaatgctgtgagagggcgtaggttgaggtggtaaaaccaagacttcaaagcagactttctggcctttgaccagtggcctttccactggatcagccattgccattagcaacgtacccattttccccacaatcttctcttcaagtacatctttgttaccaccatccctgcctattgtctttcccctcctatgactaccattgctaactttgggtaaacctctccttgctatctacatgtcatccaaaagcataatccacaataatttccctgatcaaaagtcatctgattagcaccttcacccctcctgcaacttcaatgcccctctaccatgtaacccaacaaactcacttcctgggaattaggatgtggatatctttggagggctgttattctgcctaacacatgcagtctgtctctgagcagccatttcttggcaaaaactttacactatgtaagattaacggcatcacttctcaagtcatcactatcatcaccaccttcatagtctccaaacactcagccaggtgtttctagttttgggttacttaacccttaagaatctttatttcattttgtaaactctacatgctcaattctttttttttttttaaacctcctgcattggaaggaaggacttcacagtcccaccccttttccgctccataatgttaagacttagagaaagttaaattccactttgggtggagcccaaacatgaaaggttccattccagaggaaatatttactgagaacctctctgctagaggaagagaagccatttcacagtcttaattagaacaagccttctttgacaatcaacctagacaatgtttatagctacacagtctctgtacagtgtgtcagtatctcacctcctcccaaatggggcgagaggccgtacaaattcattcaactagttgctttactaattacatcacacataccagagctaccaaggctggctgaatctaattacattaaatgcatctacatgaagatttccaatacacccagaaagatgttttcaagatttcaagccttggaataaaggctgtaatgaagtcggaccacattattctgttggtctggggtaatgtaaacacaaggcagggctctgtgtatctgactcttcctgctgtaaactcttggaggggccaaatggaacagaggatgctttccacattggatggatcccttcaggtaattctgtgctgagagtgcaaatatctctcagctgtttggatgccaaggaaaaattcaagactctcacctgccccctttcatttcagaaaactttactgtgcaccgggccttatcaggaactctgggagatgatacagggaaaacaaagatgaatgagacaagctcagggcagtccagtggatgaagaatcccaagcagcctaattattcggtactattttaaaagaatgttctttagctatttgttagatatttatttagtgatggtgggaagtaaatgatttaataatcattgtatgcagcagtaaatttacctactttacctccattggttgaaataaaatgttcaaacaacttatgttcatttctagagctcttgttttcttccctgttttaaattgtggtttgtttttaaatcagaccacttcttggacaggaaacatattaaagagttttgagtttaggcaataaaataattcaataattgccaataaacaacactctaccagcgttatgtggtttcagaattgtgactgactacctgattttacaaataagccagccatgccaaatcctatgggaagcaagcccaaagcagcccgcacgatcagatttggaggcttcatcaaagggttaggtggtgctaggccaccgtcccctgagtggtctcaggagagcgtggccattggttcactgcaaattgcatgagcttgtcacaaaaactctcagcaatgttccttggaccctagaaagaggtgcttttcattccagggtgctatcaactacagcaaaagaaaaactccttcctgctttgcccttcatgtaagggataatatcatgtaaatgagttcattggtacatatacattattacatacatattatttcatttattcaacaaatatttattatgtgcccactatgtaccaggactgttccaactactgagcctatttcaaagaacaaactacataatgtgcctgtttatgtaaagtttacattttaatggagtgtggggaaaaataataaacaactaaacaaatctatggattaattttagataatgataggttctaaggaggaaatcaaataggaagatgtgataaagaataagaacgctgggtattcaagagctcaagacatatgccattttctgaccatgggaaggggagctgatttagatttttatttgtaattgagctgagatctgattgttgagaaagaatggcccaggcaaagacttggggggaaaagtagcccaggcaaaggcaacagcaaatggaaaggcccacataagtttgtggcatcgaggaacagacagaaggctggcagggctgcagtggagcacccaggtaaatcataagggaatgaaagggcagagaagagaggcagattttacaggctatgataagaagattacattttcttctaaatgtaatggaaaaccattaaaaggtttaataaaatgagtgacatgatcttatttgcccttttaagagattctgccagttagtatgtagagaatagattattatgagaaaaagaatgggaattggacgactacttgaaacatatcacaggaatctaagcaaaaaatgagggtggcttacatgatgattacaattgtgcagtggaggtggtgagaaacagttggaatccagatatgttttggaggtggaggctacaggacttgctgtggtgtggtgtaaggtgtgggaaagagtggagtcgagaagaaccccaggtccattagccaagatgaggaaaatggggggtgggaaggcagcaacagatttggaagcacaggaaatcaagagttctgttttagacatgatccatgagatggtgtggtctgaatctgtatatatcaagttggcggctagatgtacttgcttagtggacaggtcaaagcaagagatataaattcggatcactttcttgtagacagtatttaaaagccatgggccaagagagtgtagacagagattaagttcactgatatattagtatccctttttagatcaatgcttctggaagctgcttgactggtccacttcttatcaagctctgaacacagtgcctgctttaaaggagctcacaacctaagaaaagacaggcagatggctagaaaacagtgtattgtgtattatatataatgaaggtatgggctgggcattgtgggaaaacagaggagaggatgactaataccttgagtcatgaggaagacagcatacagaaaatggcattagaaagggtcatgaaggataaggacagttttcccacatagcagaaaggaattaacatgtgcaaaggcatggaagcaggccatattggtgaggttctgtgaaacaaaatatatatatatcatatcccaaaaactagggccatgcttaatgggaagacataataaacattctcattaaagtcagcaacaaaacaaaggacttccatattcactactaccttttaacactagtctagtgatacatgccaacacaattaggaaagacaaggaattcaccaattcagaacttgccaggaggtctagttatcagtatttgcagaccatatgatcacatatttatggggaataataaaaaagtaggaaaaaatattaaaataagtaagaaaacttaaaaagtcagctatatacaaaattagtgccaaaaagaaatcaacagcctcaaatataaaaacaacaatcatttggaaagtagagcagttcccatttccaacagcaacctaaaggataaaataactagaaatctaagaaatgtgatttcaatgaaaacactgacagaacttttttcactaaacagattttaaatcgtatatggtaaatatatagcaatgagaatatttagaaaaattctgaaaaagaaaagtaagaaagacagactggatgtaccagctggtataacataaagctagagtaattaaaacatcatgggcctgatttaaaaaataaaatccagaagcagactccaaaacatatgagaatgtaaaatatgacagaggtggcattttgtatcagtggtgaaaaacacatagttaagcaaatggtgttgagacaactaggtagccatttaggaaaaaaataaagcaggattactaaatttatccatcagaccaaagtaaattcctgatgggtgtaagtcactagaaaaacacggaaaaatattttataatcttagaaatggaaagacctaagtatgagaaaaaaaaaaatcccaggaaccataaagaataaaatgtatacaactctacaaaaattaaaaattgccttcaagaaacacacaaaattaagacagacaatgacaacacacctgggataccatttgtaatacatgtaagaaaggactcattctctaaatatatacagtcaccaaaaatcaattagaaaaaggccaaaaacacaacaggaaaatgggcaaaggacctggatggacatgtctttctctgtggcacacactcccccgacacatacacaatccaaaaggatttaaaacacttaaaatgacatttaaaagaaagcaaataaactacatttcttatattgcaaattatcaaatatcaaatccttgaatggagcactattgggagagtagaaacagctattcacttgaattgttgctaggcttataaattgattcagtgcagagcaactgaatactcatataaaaatgtatagcacatgtatttttttttttttttttttttttttgagatggagtctttctctgttcaccaagctggagtacagtgaagcgatctcggctcactgcaagctccgcctcccgggttcacgccattctcctgcttcagcctctggagtagctgggactacaggcgcctgccacccattcccagctaattttttatatttttagtagagacggggtttcaccgtgttaaccaggatgatctcaatctcccgacctcgtgatccacccgcctgggccttccaaagtgctgggatcacaggtgtgagccaccgcgcccagccctagcacatgcactcttttaccctgatattctactttggagaatttattctatagatatgttggcacatgtgcataaagttgtagccacagagatattcctgcagctttgcttatattagcaaaagagtggaagtaacctcagttatcatcaataaggtggtagtttcacagataatgacatttccttacaatatttcagcagaagccattcaaagatttgctctctgtgctaaccaccaccaagacacagtgttacaatttttataataatgtgaaaagtcatctatcacttccagaaaaacaaaaggatacacacatttatgcttgtatatgtaagaaaccagcaacagtggttgcctttaggggaggaaggatgtggttgaaacacagagatgggaaggagacttacatatacctgaaccatgttcctgcatcacctgttaaaaaccaactacgtagcagaaagttgaagatcatagtcattttacattgtggcttgagattaggacgtgtgttaatggggaagatgcgggggcagagatgacagtgaataacaaaatcaatcttgtggaattatgagcattagaaaaatgttctgaacacttagcaactggcctgttgtaggtgtccagtaaatgttagctattattacccacagattacataacacgaacacacatcatttagtgaagtgggaggtttgatttgcaggtttaactagggtagagtgaattctcccattactctttctgttgcacacccagatggtaagttctggtgaaggccacctgtgagtccctgcaggccctgactgtgaggtgagagccaggggctggcctagagccacaattcctaccccagcctcagcccagaaggcatccaacccagaacacaccttttttcttggggaatgaaccctacaataacctctgcccttcatattttaaaatctccctttccataggggtgggctcccagcaaccatcctggtcctgtgtgctccctccaccaccataaacacaattgattggattaggtgcggacacctgactcaagctgatccaatcagattttcttctttgggcaatttggaacttgaacttgaaccaagtcagcctctatgcggctggaaatatgagacataaatatgggagatgtgaatcagagcagcagcagaaaactccagtcctctaaaagaaaaaagagaagaatgagtcacagaaggcttccagtttctggctctaatcccctccacaggcacagttacattagtgcctttatattttgtaagatgtttctgggttcttagaatttatgccctttttctttttttttttttttcgtttctttaagccaagttgactggtttctaggttgtcagttttttgttttgttttgttttgcaattaaaacatcaaaacctatacagacactgaaaacatggtaaatctcaacctcctattgattgtaacagaagaataaaggtgaggccaaagcaaccgctatcaagcttgagatcagcttccatacctctccccaaagcaaagccatgtgcaggggagaggatgtctattacatgtgggtgaccagagtacttagggcagcacaaagtggtagtggagaggaggggagggagagctggatgtaagaggctcccccagataatctgccatggctgttgcattcgtttctgccttcatccattcggtgttgccataacagaattcctgagactgggtaatttatacaagaaagaggtttatttagttcacagttctgttagcgggaaagtccgacagcatggcactgacatctgctgagctctggcgagggccatgggctgcttcactttcagtggaaaagcagaaaggccagtggtcacacacaaagaggcaggcaagaggggctgggctcacctataacaatcgctctctctggaactattccctgcatagtgagagaggtgatagcagcgttactccaggacccaaacgcctccctctaggcctctcctcccaacgctgccatcaggggaatcaaatgtcaacatgaattttggtgggggcaacccacgtcgaaaccatggcagttttctcggactgacataacaaaatgccacaaggtagatggcttaaaatattaataatagaaatgtattgtctcacagttttagaggcaagaagtctgaaatcagtgccacacgggacatgctctctgaaacccaaaggggaggatccttccttgcctctacctggctcctggtggtggccatcaattcttggcattccttggcttgcagctgcattgtgacaacttttgtctgtgtcatcaaatggggatctccctgtgtgtctctgtcttcccatgggtgctctcctgtgtctaaatttcccttttcttctaaggattccgtcattggattagggcccaccttaatgaccttatcttaacttgattacatctgcaaagatctaactcccaaaaaggtcacactcacaggcaccaggtgttaggacttcagtattttttggaggacacaactcaactcacagcagtggtcacagggaagaggaactactgctactcactgtgacgcttatcattcatccaggaaaacagaaatcatgctgagagtttaaagcagaggggatttggtgcagagaagaggtaacaggtgatagggaggctgagaagccaaagaggaggcagcatacaacccagagattagcaagagcagaaagctgctgccatgcctcaactgcacagacaaattgaatgtcagggttaggcaagacttggggcctgggtcacctactaagtggaaatgaggaccatggcagctctgtcaggaggaaattggagccaggcaggaggagagaaagaggatagaaatacctgggcttctttcatcctcccaccctccaatctcctgccaaggcctcaacaggccagagatctggctgacaccggagattgcagggatggcctcctgacacacagagagagcaaggattgggagagaatagagctgagggcaagcagcccaggcctggcctaatatccactgtgcatgagtctttaaagtctcacaacttaggatgtgagaattactgttctaatcttacagagatgccgagactgtgagagtgtcagtagctcactccagagcgccagctccgagatccattccaacttgggtctgcacatgtggtggctctaggggctgtggctccttcccctccacgtttgtaggttccattctgattccttcttgcctctatctgtgctgtccctaaatacacaggccccatacaaacaaaccacatgagggaaagccctcctgtaagggacccagtggacaaggacagactcaacaaccactgggtcaccatcgatatttcctctcttgccctttgggcttttgctcagatctcaggccatacctgctccctctctgactgcccctctccctctgtgacctggccctgtaaacatcctaaccctgcttccctggtgaacttctttttcatcctcgagaccttatcctagtcaacacgttttccaggaggccttctctggcccctcagaccagcccaccatgtgccccttggctgcaggcaattcctctttcattatcctcatgcgctttgtgatttggggcctggtgggacagtctgctgaaccattcattcatgggtgttctgtggttccatttcttcatttctaccaggtgcctggctttgcattcctttgctgcagggatttttccagagagaaagtggaagctgaaggaagacattgttcttcatgtaaaacacccagtcctttgcaggcaaagcaaagggtgagagcccttccttcgatgacaggaagagaggagagaaattctcaaggtggatgacggtagacagatgctgagcttagcagagaccagactgaaatgtaaccaagtgttagtggaatacttttcccctgaatacatttactaaaaattcagccttttaaacaattttttgttttgagttggtgtcttcctctgtcacccagactggaatacagggacacaatcatggctcactacagcctcaaactcctggcctccagagatcctcccaccttggcctcccaacatgctgggctttttaacaattttaagtcatatgttgacatggctgctgttaagaatatgacagatgatagaggaaagaaattggacaattaagtgcccagtctcctattagaagttggacaagagtacctactcccctatcatccaagggtggctcaggccctattctgcagaccaccccctcccctccctggttagagcctgcctgtgtctccgacagaagtgtgcctagggagctgtgaatattcctcagagagatggccaaggcgtgcacctgaggacgccagggccttgtcatggactttccagctcaggtggacattcatatacccacaggtcacactgacacagcagaacacactgagctgcctcacatcttggcctgcttgcccatctggagactgaggtaaaatagagatgttggcagcagctatgatggaccagaaaccagaggcccttcctgtgttttcagaatcctcgtgaaggccctgggcttctggtgcaaaactaggagttggaatttcctgctgccctggcaggatgagagcttagagtcagctttgacttaaagaaaacaaacaaaagtgtgtatttttgcacatgaattgttgactgaggttcatgcccacacgatttgtttaacgtgtgacttttccaagtccctgacagccaagactgcctgaactcacggcccaacgccccaacgcatagtaagtgctcggtcaatatttcctgagtcgagtgaatgggtagttttggaagtcaaatcttggaagagcatttctctgtttcctccgggcagaccctgcaggcatcagctccaggaggcattcgtcctgacggtcccctaaaccctgctgacacatgagcagacactgcacaactgcactggcggtttctgtccagacaggcactccctctgtggtgagaaatacctctgaagttgcctagcatcttggggctccttgcccatctttagaattttcaagtgccccaagctattgtgaatgtgttcaatgtttatattccaagcagcttgaatctatgccttgcaaaaatgcaagttggaaagttaattcattcctttatgtcaaggtaattgcagtttcaccctaatcctctcttgtcaaagacatttctacaatgcagggagttatcttttacaagagacacttcaaggtgatttaataacaacacttgctatgagtcacattttccctgtagtcatctactcttcagcttgggagagcagggcttcaagtacagaagagagaaggcatttggctagtcacataacccacttacacacgctcagccaaatgtacaccttcaagagaaaaagaaagccctaatgagcacttgtggtaactaaggtgctaaacgagatctttccaagcaatgctatttttgtttgtttgctttagggcaagctatattcactcagtgctttgaaacttaagacacgtatgaatttcatgactgcggacaaagaggaaatttgatatggagattaattattaattcaacatttactgagcccctactatgagctgtgctaggggcttggctacaacagcacacaggcttgcctgccagctgccctcaccaagctagtggtccagcaggactgcagatgtcaaacaaataacaaaggccaaagatgtctctttctctctctgtctgtgtctcttttaaatgcaaaactataaatttattttatatactcctttttacttcatctgcatgataaaaggaatacagatgtattttttaatgtaaccaaattcccatctcactgcgcagtaggaaaaagtctacccactcctcacagtttctagttctcccctcacagtggagctcatcaaaaggcagaggacattggctgggacgtgaccaggtttcaggcaatttgggagtgaaaggccagcaggcagctttatcttgaagactgttcagctccacagggtgacagattctcccaccaaccatgtctctgtcagcctcagcccaagagaaaattgagctgaataagagaggtctcagtggaaattatattggaaagactcaccataatggcttcctgaaaaaaatacataaacaaaacacatttttccatccaaattaaacaagtaggtcaagagggcaactttgccaagtgccacttactcccacctccagctggaattttctgggcatgccagcactggtgttacttgccgtaggcagattctctacccatacttacaaaaatccacaccagctacttctgatggagttcttagcgtgcctctttcaactggatttctaaacaaggaacaatgtaattggcaggtaataacaggctaacaggattgtcttaacagatactggtgccttttcagttcagactttcaccagccaagaggttctatacaaaagatccacacatcagagccatgtgatgagaggccaaaacactggagagctgtaaccctgaatgaaggagtcaggtttacatattgattcaaaaaaaaattgctactcttatccctgtgtgacatcatgctttgaatatgatcattgaagatgttacttggagtgcagctaccttgaaccctcggtgaaatgaaatgggatagaaaggagtaagattgttgggggctttaactaccgttccacacttttgaaagttagaaaaacaaagagcaacagcagctgcctctgtgttggtaatcatattttccaccagcaactggctcccattggttggagccaatcctttgctgtaacagaggatctaagctgccaagagaaggtcctcatgttcagatagagcaatagagcggagcatttgaaatgaggagcttcacaccagtcccctgtaggtctgagtgcctgaggctccctgcaatgcgtgcacacagtcattatgctgctccacagaaagagatgggagctggatgagtccttccctgatgacttgtatgagctaatgatcctaccggaaatagaaaaaaaaaagaaaagaaaaaacactagtcatgtgatttcaagacagtgacaaaagcttaagctgaggttgccacaaaaggttgtgggaaggggtgtggtctataggcatgggtgcagccagggctgagaacgactagttagctgaaaacagctgcttttcttcaccaaaatatatgggtgaataatgcaccctgttttccagggggataatgcaaacaagtgctctgtcaaggtaatttttgtattccacagggatggcggggccatgtggggaaccacagctgtggagtggggatgtagtattgcttagagccaggtgtgtgggtcccaaagcagatgtcagtgcttaaaattagtaggaatgggagagccatgcctagatctttgctctgagatacagtcgtagtacccaaaaaagaagttccggtagtgggaaatgtagatttagagctgggctgtttgacgggaaggcagggaatggcttatgcaccagcagaaagccagtttccaccttgcatatccagtgaggttgccacagggccatgaccttcattcctggggtgccctgccctcagctcattgggtgtctgtgtggctagagtttggttctgtgtgaggagcaacttggaggggggaatggactttagctcaattcaaccaacatgactgtatattcactcggcatcaggtactgggatttcaaaaaactggacattgatgtagcacactgataatggagccaaaatctaaaccactctggaaaatccagggtgaccactgtacttaagtgccacaaatagctattttgcataatcaaagctttgggcttgaaggctttgttcatgcttttgctgctcactcatgacctttctcaggaattagtgctgccatatgttggagatttacctgtattagattttcacatgcatgagactcgatccttggcttcaactcagcaaatgtctatctctctagggcttcctatccaaatctttccagtctttcaaatgcctgtctgggagaagaagaattttggactttcaaaacaaaagctaagaaaggcctagtgagccccagtggtatgaacccatcctgtgctcattcgcattctactcagactttctgccatagcaatctgtttgttgtaacccaaccacacttctagcaaaaggtaacatttggggaccctgctctaacaaatttagagtaacccaattccatgttttctgcactgagcaacatgtacaactatcaccttgaaaattatgctggatctcagttactgagtcacatctgtccgagattagtagccccgagggctgggatgcttagtgctagtttcatattagaatcatctgagaagcttgaaaaagtgttggtacctggcaccccaccaccaaagattctaatttaattgttcttggttgggacaatgttttcttttaatctttgctaggcttcataatattactgctaatcagttttagagagtgagtgcttataaccaaactcccagcctggtttactacagcccctgtatttcctccttgatgccatttagcaatgacccatggacttttgatgactggacatctttagttctctggatggaaatctgaagatgaaggagaccttctgtgccaaatagaagcctgagatttttagtgaaactaacatacgtcatctggtcttcgtgaaacgattctgaggtttctaagaatttcccacaacactgaagattggtggcttagagtttattgacccccaaagaaaagggtatgtttgactgtgagatacagttgtccttgccattttcaagatattacccactgtctttgtattgaattaccttaaaagtattgactcatagaagcaacccacatggttaaacccaactttaatccaaaagtcttggtcatcaacaaggttttctccaactatagaaaaatgtgctccccaaatttgccacattctcattctctccatgtaacaaaaaagaaacaaactcttcattgtctggcccacttggatctttttatctcaaataattttttaaaaaatgcttatgttggcttggcttggtgactcatgcctgtaatcccagcactttgggagcccaaggcaggaggatcatttgagtccaggagtttgagaccatcccggggaacatggcaaaacattgtctctaaaaaaaaaaaaaaagccaggaatggtgatgcatagctacagtatcacctgagcctgggaagttgaggctgcagtgaaccaaatcgcaccactgtactctagcctgagtgatagagtgagaccatgtctcaaaaaaacaaacacacaacaacaaaaaatccaaaaaccagcttattttgagggttgggggaaataaatgacgaaggctagattcattttggactcaattctagctcctcagggaactttgaatgtatgccattcttgatatttatatttaatcccgactaggaaagagggaagtccaagattgctggatttttgtctctccatgccatttaggaatatctcaagactctttccactggagttgaaaaacaccaggtcctagttctgagttacttctgatactgaggtgttcctcctaggttttcagtacattttgtttacatctctacgtgtttcattgtcttatttttgttagctgggtttgtttcctgtctgcctcccatgaggtccttcagggctgaggctgaatcttttctcctaaatgcatccaatctgaacccaaagtcggtactcaaatgtgtgacaataaatgaagacacaaatgaatgatgtatcaactccccccaaagctagctgcaaggagcctagctgtaggacaagagggaaaggccgtggccacaagggagtaaccatgcgcggagcctggactacagagatttattgctaaggctcatgcttttgcctccatttgcccaccgttgttttgtcagtcaatgtctgtagttgttgaataacattcatttatacattatttagtaggtgtaatcaaagtccccatgatcacggccctgcttttaaaacttgcctcttatctgtaaacacatttcctgagctgctctatcttttcatcttgtctaggtgatctatagcaatatcccagaacctgcctattttctttttaattccctgatggattataaatagcctcttctaaacctccccaaagctttgacggcaaattcctgctttctaaattactatccacctcttgctccgcactcagaccccttcaggaggctgtcctccttccccagggcagacacaaaagccttctacacttccctggcgtcatgctaaaggaacactatggcaacgaccaatgtttggaacgattgcagccgaacacacacatcgctcactgcttcaaatgcttaatagcggtgattaaagaagagaaatctggcataaaagaatggcgggagaagaaagcaaatgagagagaacaatgagtgacaggagaaaaggaaggagtgaggagagacctgagggaaacctgggagaacagaaatgaagacaagaagggaaaagggaacaatggggaccagagtgcaccccggcctgctttctttgaccttaggccctgcacatttgctaaaacacccaagtctgtcaaaccaccactgaagcaaatgctgttagaagaggcaacgtggctggaaagaactcggtgctctgtgatgccccatggatcctttctattctgcagataagagagagaaaaagccccattgcctaacttcctggattgcagagaaactgctgggcacatggtggatccggggacccaccgttctcaagaacttgctgtaatgggcaccttggatgtacacttacgaaggattgtgtttccaagacacttcctcctccactcaaaatttgctcatacttgcaaacaggaatcatcttctacccaaacccccatgaccatctctcaggccagagttgagcagccaggttgcccttctctgagcttgactctttctgtgtattaattttcaatttcaagtcacaacgtaatccattaagaagcacttattctcagcaaacctcttgagcaggctctcatttgctatttctcagtataaactcattcctaccttccggttcagtgttgacactaaatttggcacagtggctcagcacccaccttcatccctgcatcaatctccagttggttttctcatgcctccacaccatcaaaatcagcctcggcttttctgaatctccatggggcttagcagatggggtggcacttcataaatccagtctatgcaaagctgttagcaaaaatgcacagagggcagcctctcggccttctgtgggtatgctctgagctgctccaaaggtatccttaaacatggtatcattttgagcctctaaactctaaatagctaagccttctctacaatttatgccccttggcatccctgaaagtgggtaaaccgcactggttttgagtgaacatcctttaaaaaaaactcaatttcttaggatccaagtctatatgattgaaggacacagaaatgtacaaacgtgttcccaaaggcttgatgctgtgtaattgtaggcccctcttccctggagttaatctttattgtgagtttaccatgttccaggcattgtgctgattttcaggcattatctcatttgatccacccccaaactccagaatgatctttaaaacagaaatcagatgatgatgcttctcagcacagaactctccagtggctgtctcacttggaggaaaagtaaagtcctactgtgggctgtcatgaggcccctgtgagctctctgatggtgttttctagagaatcacctttcagttctgcactctagctggtcttgcggttgccctcatttgtcaactaactcccctctctcccctatgcttgtcttttttactctcaaatgtcatcttctcagggagaagatggctgcccagtgtacattgtacctcatctcctccccacatcccattcgttgctcacattctcttcatttcacccccactgtcaacctgctacatatttgtttactgtctccaccaactagaaagtagctggagaaggacaggacttctgttcactttgaatccccaggacctacaagaatggtgttttcaataaaacattttttagtaaataaatgcattaaagtattcttcttatctccattttacagttgagaaacaggtttagggaggttaattaactaaggtcttagagccagtaagtacaactagtactatgggctcaccaaccgctattcccaagttcaaaatgtcttttttcgcaagttcaaaatgtctttttgggaaatatttttgccatgctcattcaattgggggtgatttgaccaaagtgggaagctgagatggaacaagatgaacaagaaatcaccgggaggctgggtctggaatctgctatgcacactcacactcctccagactcacttatcttgtagggtctcctcacgtcactcttgacatcgaccaaattcaatcctttattaaatatacaccatagcattaaagtgcaggacagataagatcatataaattttttgacattttgaggaacaatgtgacactgctattaatatttgtaagtatcttggaaccatttactagatgcaatgtttgtgtgagggaaaagattatataaaatgagacacatcaacctcaaatacactagtctgtaaactcctagagggtagctactgtgctatattctccctgattagcaccaagaatgatctattgtaggcattcgataaatgttattgaatggataaatatctttggaaatgaaattttagttttgtctgcaagagcagatttggatagtggcatcttttccaggccaggcaatgacacacagttgtatgaaaacaatgccagggcagggtcagttacatttgaaagaaagtcataatcccagtggaaagttttacagatgaaatatatagttgcatggaatatcctgttataagagagaaacctggacagaatctgccacctcagtgctgggagggaatatatgttgttgaaatgtggcctccaaacagccagtcaggaggtgggttgctctccagccattaaaaacatcccagaggccaggcacggtggctcatacccataatcctaacactttgggaggccgagttgggcagatcacttgaggtcaggagttcgagaccaagcctggccaacatggtgaaatcctgtatctacaaccccgtctgcactaaaaatacaaaacttagctaggcgtggtggtgggtgcctatagtcccaactactcaggagactgaggcaggagaattgcttgaaccagggaggcggaggttgtagtgagctgagatcacaccattgcactccagcctggtcaaaagaacaagaccctgtctcaaacaaaaacaaaaacaaacaaacaaaaaaaacccaaaaccaaaaacaaaaccatccctgagggaaagacaaatggccatgatttacaaccagaaagttgaattggtgaagccataaacaagcagtctaaaaaaatcccagctgagactttttctctatataatctcttcttcctgccccatcaggcctcagagctctgccatatttcccttcaggggaggagaaggaagccccactgaggaacaaaatttccacaagtacccctgcttccttgggtttgtccaagtgcctgggatatcaggaagtgccttcaggtatccagcacttttggttcaagaaacaatataattccttatccaaccaccaaactcctaaagggaggaaggccagccttcaaagtggacagccatccagatgacattctagattcctcctactgacctggcaacacagggaacctctacttgagtgagcgcaggacatcgtgactagcttccaataaatacaatatggcaaaagtgatgggatattatttccatgattaggttataaaagactattacttccatctttctagcagacttttttttttatttttgagacagagtctttctctgtcaccaggctggaatgcagtggcgcgatctcggctcactgcaacctctgcctcccaggttcaagtgattctcctgcctcagcctcctgagtagctggggctataggcgcgtgccaccacatccacccaatttttatatttttagtagaaacggggtttcaccatgttggccagggtggtctcgatttcttgacctcgtgatccgcccacctcggcctcccaaactactgggattacaggcgtgagccaccacgcctggccagcagactctcttactggctttaataaagcaatctggcagtttgggaagcccaggtggcaagaaactgagcgtgtccttcagccaactgccagcaaggaactggggccctcagtccaacagcccatgataaaactgaattctgccaacaatcactaagcgaacttggaaacaccatgccccagttgaaccagtaacttggtttcatccataggaaaggccctgagctgcaagatctagccaagccatatctagattacacagaaactgtgacataataaatatgtattgttttaagctgctgacttttgagggcaatttgttacacagcaatagataatccaatataataaaaatgtaatgaaaactcagtgagatacacatgcaaagattcttgttaaaagtgtgaagcttgggatcataggatacttacagtagatactctctggaggagaagtatggggtcctacttcacaatgcaaagctgttcatgctattccaacctccacccccactatagctgcccatttatccactaaatcaagcacgagttccttagtctagcaacaaggtctgacatcatgtggtctctgcctatttctccaattttatctcctgctttcctaccacttgcactccgcctttaagtcataccaaactacatgtagttgccccaaatgctgtatacttttctctttttccctactgttccctctgcctagaatgccttcctgtacaggttcagttacaagcatctttggtgctctgtagaactccattcaaatccttacactgtcctctcaactctcttataccacatgtccacctgtcttataacctttggtttctttgtctaatacctctctagctgtaagctctgtattgagcctcttcttcaacctgggatcctcagagctagtttgcagtctggcaaatcacttcagtcaacaactaacgaaagaataactgtgggatggacgtgccagaaggagaaacaattatttattggcttaactgtaatttataccatgctattgaaataataggcagtgtaaaggacctacattcaggaaggttagtagcatacaaaattaaaagccacatagaaggatgaaaaagcaaatctgccaaacagtaggcatgtttgtcacaatgaaggattacatttcatcctaagtttgccatcagacaagcaagaaaattccaaggaattatgaatttgcctacaccttccaattgggttcatcctcaaaattcctccattaagacaaaagaaaggcttccacatggtttgtgaaaattattcaggtttccatgctatatatcagttctactcaccttcctggtgtaccaaatcagttcaaagagaaagaggaggggattttaaaatgaatatcttatttttatgcccttcaggaaatctgccttcctccccatttgttaccaactaaaattgacaaactgacccagagttaaatcaacttagggatcactcaaggagtgaaaccaaccaccttttcataaagaaatgctcagagaagaaggtagcaattacactttatcagagaaaatgtctttcttacaaagtatagccatcaagtggagatgtttgatgatccttttaaaatatctttaaatcagaagtaacttagcatggatgcccttcattttgaagaaagagaaaatatttgatgatttgatgattcatcaaaaatttgtttctatgcaacaggcttattgttatgagggatttcaatgcaaaattaataatcagccttggaaaagaaatgccttgaatcctataaaactgagatgacttaaaaagttctattcctgctcagtcaacttactgaaaaccaccatcatctttgatcaacagaagggaatatatccaaaagctaagctaaaatctctctttctttaggtcataaatcaactctgcaatcaagactacggagagtccgtgccacgcagatggctttgagttttataaattggttaggtgtggggacatgatcaatagtttgatgatttgactaagtaaaatgtgctgaaaaaaaccacctgtagggaggactcagatgactctgcacaaacattcttgaacttgaaaatccaaactgttagtcatattgagactaacaaagttaatatatgccaccaaaggagaaggctatatcatctcagggaaacaatttttgactgtgcttagtatttaggaaataatgcattcattgaaaggtaaaactggcagtaggcttacgatggcaatgggcagtgccagcagtggctgtggcatcctggagcaggaagatttggtgcatttctagtgcagcataggccagagtgacgtttctgacatttgggatgctacagcactgatagaagtggatgataaagctgtggcttcatttaaacaggctctaaagaatgatgacatttgtgaaacctcagataaaccaaaaagcatgcctaatagaaaacctgctaagaagcataaaggccaaaaaaagaatactgtaactttcttgaagtagtggaaagttggggacaaatgtcctgccatttggtcagaagacagctgcatttactctgctaccattgcttcagttgatatgaagagagaaagctgtgttgtgatttacactggatatggaaatagagaggagcaaatctgtctgatctactttcttcaacctctgtagctaataatataggacagaatgctcaaaagaatgaaaatgaaagtcaagattcaatggatgaaagtgagaactccaggtcctggaaacaaaccatttagcatcaggtcagaagctactccatggaattctgagaccacgaaagccaggtcaggtctcaaattcagtagcccaccacccacaccaccctgcttcccctcatgcttgctgcctccatttccttctggaccaccaaaaattcccccaccacctcccacaggtctagattttcttgatgatgttaatgttttatgaagtatgctaatctcttggtacattaagtggctatcatactggctattatacagggctcaagcaaaattaaaaagagggagagtgctcacgttccaattaatgagtaaatatgccattattataaaagtgaatcttacttttgtaaaattttatggtttgtggaaagcaaatgtcttggaatatttttaaatttaaaatgttaaaaagttgaaaggttaatgtaaaacagtattaaagacattctgataccaaaactattagataaaaggttgagctacatccctactagaattctcatggtatcaaagtatcacctcaccaaaaacttactggttggttgtgtggaaaaaatatacttttacaataaagagttccgtaggctctgatgacattttacatcactagtagtcagaaaaaacagacatgttttctgacctgtgatgcggtatgacctacgcatactgcactggtacactctatgacctgtgaagtgctctggtcaaaaaactttaactgaaatttaatcaggcctttagatctaatttcctgtttgcaggagatgctagggatagagcaacaagttaaatgacaccactaaagaaacgatcagacagatccagaatatagaatgttatagaagataactggcctcattgcttcaaaatatcagtgttgccaaaaataaaaataaaaaaaggtggaacgggtaactcttccagattaaaagctacttaagagacatcataacctaatgcaatgtggaatctttgattaaacctaagggggctgagaaaatttgaatatggactagattttgaatactagaccattattgctaattttatgagctgtgagaaggatgttgtagtttataaaagaatgccttcatttgcatactgatttaagaatgaggtgttatagtgtcccttaaaatgttttaaaatggttttgcaaaatgcgcatgaagcatatatggcaaaatgttaatgaatctaactggtgtgtatatgggtgttcaatgtgctattttttcctattttctgtatgtttaaaagtatatatatatttttaaattaaaaaggcaacactgaaacaagaataaacagttttcttcttacgctagaattgctacaaatttgattatgtaaaagaaactttaaaaagttatacttggtgtgggtttgctgaatcaggacagaccaaagctttcagtgccaatagttgtctccctcagagaaaattcgattggtgcattcttctggtttactgttgtccagattgagttttatttgatttgactttttcttatctacagtgctttagaggacttcttcatctttttttattgataacttaccagacaacctaacaggcaactatatctactatccaggcagccatcaacacacagaaaggctgaggagaatcaatcagggaccaaaacattccatgccaccagcatataaccttgcccttcatacactcccaacccagcctcaggaatactggccacaagggaaaatcagccaaatgctggagctgagaatgcgggttagtttgctctaagtaagtaaaggcacagctttaagttctttgtagcactccactacacaatgtttcctacaactctctgataagaattacctgaagcatgtgtgttaagcctgcagctttctagggacagcccccagagtctgggtcagaaagcctggaatggagacagccctcagaaatctacatttgtgacaaggaaaacagaatcctgatagctaaaagtgccaaaagattgttgctaggatggcagcccccaaacatagctgcacgctagaatcaccaaaggaacgttcacaattcagtaggacttactgaataaggatccctggcagtgggaaccaggactttattttttacactcccaccttgactgcatattagaataatctggggagcatttgaagatgccagtatccaaggcctcatgcaaaacgactgactcagaacctctcaaagaggagtagtttgtaaaagctccttaggtgatgaaaccagaccacagctcagcatatggaaaacactgaattgagtgctttaagatgaagctgggattatcagcttttaatctttattctccaagccagagcagcaaaaaggaactatacatcgactttgggacccacttagctgggctggtgctccaggctgctcgctgtgcatagctttaagttgaaccattgattcaggtctctctaaaaagcctatgaaattcagatcaaattaaaaagtgtcccatctgtaatgggaataaggaggctgggagcccagaaatggtgttcagtctgtctgccagttaaggatttccatatagcttcaaagaagttctaaccacatgatgacattgttgctcaggagtgaagagattctactaccagcaaaatggaaaggaaatactctggacacagcagctatattttcacagggtcctcaggatagtggtcggcacatggtaggcactcagtaaatatctcacgaatgattcccattaccatggctaaaacatgagtcttttaagatgtcttactgtggatctgtctccaacttcggaagaaattgccaccacagtcatcatcatgaattatgttactatgaataactggaactagcagcaaattgctttaattttaatgtgggccaaataagttctgcttagatatttaaatagactttacttaaacattctgaaggatggagatttcaaagctggcacctccctacctgtgaggcataataatggttccccaaagatgactactttctactccctagaacctgtgaatatgttacagtacctggtaaatgagcaaagttaaggattttgagctagggaaatgttcctagattatctgtgtggtcccaagataattcaagtttcattagaagatgaaagaaagactgcatggtggctcatggcctgcaatcccaacactttggaaggccaaggcaggagaatggcttgaggccagaagttcaagaccagcttgggcaacatggcaagaccctatatctacaaaaaataaattagcggggtgtggtggtgcatgcttatagtcccagctactaggaaggctgaggtgggaggatcgcttgaacccaggaagtcgagactacagtgagctgtgatcacgccactgcattctagcctgggtgacagagcgagaccctgcctcaggggaaaaaaaaatgatggaagacagacacagttcagacagagagagtggaagaagctatgcttctagctttgaagatagaggaagggccatgagccaaggaatgcaggtggcctctagaagatgaaaaaggtagagaaatggattctcccccagaaaagacactggaagaaatgcagccttgttgacagtttgattttaacccagtgaaactcactttacacttctgacccctgaagttgtaagaaaataaatctgtgttattttaagccacaaagtttatggcaatttgttacaacaataggaaactaacacatcacacaatatttaagagaaaaaaataatttggagaataatagtgactacattagcatttctttgcatttcaacatagcaaagggctacatttgtatcctctataagatgatgtggctagccacatccctttcaaaactgtgatatggcttttaagagtataatggtgaaataaaggttactgagatgcttgctataaataaaatcacagactatacaataaaatgaccatttctatgtggtatatgtgccttaagaaaaagtgacatcattctaaggtcttgtacatggtaaataaatgagtagaacgtctggctaaccaagatcacaacttgggcttactccggtgaatgcccaacactctctagagaatggcttcccacgcaaataccactcaccaaaggtgtaaggcactgctgcataaagatgacagtgatgctcatactgcatacccacccttctccagaaggcactatacaaccatgtttgaaagggcgtgctctcacactgtccttcctatgatccagggcactattcatgacatgtttgtgtaggctcaggaagtgtgtagtcatgcaagggggcaaaccagtgggttgaaaaggggcttgaacctatgacctcagcttcaccagtgttacctctagcaattgagctcatcaggtggaaatgggttcaactctatcagtcctatgtggcccagctctgaggcaagagacctggctccctttcattccaatgggctgaaaacagctttgaaggagcagcagtcagttacatagctgatgactgccctgcaagaatgtgcacctgaggaagggcaatgatcacaataggctgaagacactcggggctgaatggcaaacagcaccagtgtaatcctacatattggcaaaattctccaccaactagagaatagagaattgtttcatcagactccaacagcatcatgactaccatttattaagcactttactgtggaccaggcacagtgtgctaagtgtgctacaaacatctaattttaacaatcaccttaaacagaggtccattgttcatctcatctcacaaatgagaaaaccaaagtgtgggaaagtatgttgttttaaggttatatggctaggagtgacagacctggcattcaaaaccaaatctttctgcctctaatgttatactacctttaatacagtagcagaataagacacacttttaaggaaagaggcagcagagaattggcatcaaggtagcaacttacttgcaagccaaggaagatatttatttacggccatttatttaatcggttcatcattttttgagcatttggtctacgctaggaattgtgcccatacgacttggaatcaccaaaatatcaaagggtatcaggtagtaggacttggagacacagtgaaaacctacaaagttccagaacatgctctaacagggagaggacctgccagctgagcaattccaccctggacatggcagcggcagccagaatgacttggcaggtgacaatgaagaggtagcatctcaaacaaaggtgtcaagtttgaggaaaacaaacacaacctcaacatgcaacaggctcaggaaatggggccagagaccccaaatatggaatgcgcccttcttccttgcaggactgatgttcaataccggcctattcacctgttcaactgataggctaacacaagggcgggggtgaggaaggaagggctggcttggagaccacatcacctgcaaagcctcttcagcaacactgacaacgccctttaaaccctggatcctgtgggcctacccttaatatgagggagatgctcaattgttaccacaaagcagcagctgtcaaggttcagaacacaatatcccaaaatatggcaccttggcatactgagtattttaaactgaaggaaactgacaaaactcagaagcagaaagagcactctttttgccacatttctcccatgaagattggtcatttaaaaatttttctgtgctgggcgtggtggctcatgcttgtaatcccagcactttgggaggccgaggcaggtggatcacctgaggtcaggagttcaacaccagcctggccaacatggtgaaacctcgtctctactaaaaatacaaaaagttagccgggcgtggtggcagacgcctgtaatcccagctattcaggaggttgaggcaggagaatcacttgaatccgggaggcggaggttgcagtgagccaagatcaggccactgcactccagcctggtcaacaaggcgagagtccttctaaaaaatttctgacttacctcacctgaaaggaggtcaaaaagatcctcattccaaaggagtcctgccctataccctgaggtcagaagaatctgaacaatcaggccttgctaagtgcccccagtttattaccattaggtcataccgcctttatggatacttccgtacgactgtccattcttcatcaaagttaagcataaaaatggagcttcctctgggtctcttggaccttcatttctaatggctcccatgtcacacaaaactttggttgaatctgctctgcttctctcttgttaatctatttttaatgtaggggtgtcagccatgaaccttgcaatgggtgaagaaagatattttttctaccctacacagcccaaccaaaccatatgcatcataagtgcatatgataaaagtgatggaaagagaaatctgaaggtatactttcagttccacatgtcccaaagtgttttcctcgaaactacagtgaccacatgccctgatttgccaaagacagctttgatttattcatgttgtcctgggatgattattaatagtgtcccatttccttctcaaaaatgttccagtttgccagatctagtggtatggacctgtagtcccaactacttctgagaccaaagcgggaggttcacttaagcctaggagttcaagaccatagcatgttattatgtgcctgtgaatagctactgcactacagccctggcaacgtagagaaatcctgtatgtaaaaaaaaaaaaaaaaaaaaaaaaaaaattccagtttggccaaaaagttacatggttagctaatccagaaaaccacttctagagatagtaatagccgtgttgtccttctctgaaactgtgctacccaaactatgttataaaccttgaagaatgaaatacagtttaaaaacgattttgaggctgggcgcggtggctcaggcctgtaatttcagcactttgggaggcagaggcaggcggatcacaaggtcaggagatcaagaccatcctggctaacacggtgaaaccccgtctgtactaaaaatacaacaaaaaattagccaggcgtggtggcgggcacctgtagtcccagctacttgggaggctgaggcaggagaatggcgtgaacacggcaggtggtacttgcagtgagccgagatcgcgccactgcactccagcctgggtgactgagccagactccgtctcataaaaaaacaataaaataaaataaaaactattttgataaagaaacattattttaaatgccaaacagctattattatcttgcataactactattgtgttacatactgtttgggaaatattgcattaaataaagttaaacaagtttgactattggtggaacatgtggctttccaagatttaatattttagtacgtcatgaattgccaagagggtcatatactgggcaatttttccaaacttaaacgcaaaaccatttctcatgaaatgtcaaaagaggttcatgttccacaaaatgctcccacattttcatttgataaatagaggtgtctcgtatgtcttggacttgttctaggtcctggaatcagcagtgaacaaaccaaacttcttgccctcaggtgcttctgttctagtgggggagacagataataaacatggaaacaaataagtattgtaatttggaaaacaatgatttatcccccaactgattcaaagtcaaaactcccgacatctaacaattctgagggatattcatgaagcagcctgtcttcagatgtgagttggcaatgatttgtgtctctcaaaagccatcgtcgggcatcgtgtttcctgaataaaagaagcttcccttaagaagtctccgcctttgaactaagcgcgcttcatttggcattctcattagtatagatgtgcttttgggggagtccacctttatttagattgcttgtggaccgtattcgtgtgtacctttaatttaatgctatttcctgtcctagctagaccgaggtgttatttaaaacagcgtccctttcaaaagagatgttaataggtgcttagcacccagggaatacattccaacaaatgaagagttatacattctatgccacacatcccatcccctagggctggggtggcgagagacaagaaggttcatacacacacacagacacacacacacacacacacacacacacacacacacacacacacacactcctaccctctgattggttctgtgcagaatagagactcacatttaaatgaataagccaagttaaaactttccatcctggaacaaagcaaaaggaaagcctctttatgttgcagggactatagatgccacgggctgagcctgtcccaaagcttccctccactgctcaaaaactaagccatcttgctgcgtttagcacttctcaccagaccacccacccagacacggatacacaaaccacatgtgtgaggaatgctgttcggctaggaaatcagtatcagtatttcaaccttgttacttgcacagacggcccttttagtgcgactcatttgttttatcttttcaatagctttgattattttcttttaatggcctggatttatccttttctacccttttgaagcctcagaactctgtggtggggactgcatggggtgggagacatgactacatgattaaggggaaaatgagcaaataacgttgtctttactcaccatctatctcccactccttgtgggcacctcccattccatgcggactgccgagtgccctagtagtcaccctgaattgttataaaagtggactcaaggagccttctcattcaggtcgaagactatttgtgctgttatttaagagccatagggcccagttatcattatcagagtgttttctggtttgtgccgtatatttctctcactagctcctagggaccacattggttacccttctttaattaaggggaaattaagaccaagaggctaagctgagagccaaaggcaatttaacaacctctggaaaaaattggaaacgcctctacagaaggggaccgcataaacaggaaggtatggatactattacctggcagagaaagcagaagctttgaaatgtgctccgtgttttctatttgggtggtatccctggcaaggaaaccaataaaatacccttagttgttctactaatcagaataaaacaagaccactagttttggagacttatttccctgaattagcaaccagagaggtctgggggtcaggcttggttatctgtcatctctctccaggtttccttgcatatcgaaatggggccataaattggagagacaggaaacaaattattggggaaaaccatgtggtgcagtgcacccctgggtgagtgtgcttcagcagggcctggggctgatcttgaccctttctatacagtggagaaggtgtaaggccattattttaaataaaattgagtatctatgccacaacaagggaacagattagtccaatccaagtatggtcattagaaagttctactgccaccccaacccatctgggactgatgcttccacacctaaactcagtttcgggttgataagagacaaagcagtcccctctaatcccctaaatggcttgtcagcctgaatgaagataaagtcagtttctcaaatttgatgtaaatctccttactattaagtaagagcatcacatccaattccttggttatttaccaaactgaatgtattttattctctttgttgtagtagttgttctccttcctgtctaatcaaggtagcagttcttgctgtgaaagtaaatgcagggactttgtaagatcgactctctctggctatagcacattgtttctgaacaaaaccctccaaagaaataggggggaaagaaaaaataccgggcacacatagcccagtttatgccaaaaaatgtatcccaccacttcttgttccaatctttgcagagttttaaaaatattatatatatactggctttaggacacagaagatggtgttagacatgagggactcctaaaatgaatgaggcatggactctctgccttcagctggttttggacacattgtcctctctctggatgtctcagatctccccatctattcttctttagaaacagcatcacttcttgagaaaaggctaggggctaatttttcctgtatgcaaaataaagccaaactttggtcaaatgactctcagcaaatcagtacaattatacattttaaaaaaggtgctgaaacagattatatgagtttaagtaaaacacctatttctatcaatctgtacttacatttcaacatggattttagagaagggaaatacatcttacagtgtgccttgaattcacacaaaagcatgtacacatacacaatgtatctttcaacataactacacatacacagtccattaaaaagatactgacagatttataaaatgtattggccttgcactgttaatctcaataatacattttcacttaatttatttttgcactgcatggtagctctggccaccattaaggatctgtcagcatttccatcataactctattttcagaatactggagtacaagtgccaaaatacacatttacagtttacagacagcggtggctttgtcttccttttaaattgacttcttcactgcatctttacaaggaatattcagggatggcagtgcctacataataaaaagcatcatataaaacaaaagaggtcaaaagatgtagacttccagcccgagactaaactaaaccatgggaattgactccttaacattcactgcagctgtagtagtctctacatcatattcatagttttagagcaacagtccaaagcaagattactctgataatatatatgtgtatatatatatatatatgtatatataaatataggagcagtacatagcattagtacacaaaacgctaaaggtggaaagtaataagcatacagcaaattactccagagcagatcacttctacagtgacaaaaataaacacgagccaccaaacagacactgactgtttccaacactggacatccaactccattaagtaggcaaagttaaaacatttaagagtaaagtctctcttaaacaaatatattaactacatttgtggagcttgaagtagtaaataggatgttatacaggcctaaaattgtttcttctcttttttttaaagattaggtgggcctgtaaaagatatcggcaaaaaaaaaaaaaaaaaaaaaaaaaaaaaaattttgaagaaactttttagtggaagaaaaccaatattactggctctttccaccaaaaggtgaatattcagattagagagatttaaattgcctagcaatttaaaatgtttaagacactctcttaagagatatttttttcctgatctgaagtttttatagtcttccctaccttgacactatatgaacgcatttatagacatacctatttgtctgtattaagattgagagagaggcagattatgctgaggatggtgaagtaactgcaaaatattgttgctaacatgactgttacatccgaagacagaaggaaccccaaacccaccaacacacatcctgctgcaaaaccagaggcaaaagctaagttataagggggcagaggggcaggagctctgtacatatattttttcccctggctgatcactgaggaaaaattttttaaaagtttatcatactctggctggttcaaaccatattcacatttacccaattaattttatttgaaacatctatttatatatgtacaccaaagaaattaaaccctgccattttccctttgtgcttaagaaaccagagccactgttagggtactcacatgtcaaagatattcttaataggcttcaaagttgggtgtatataaatgtgacagaactgaaggggttactttaagagaggtattaaaactacttgaaattaattcaaagggatctttttatttctgtatttaaaaattagatgagagcaagattaccacttcaaaaaaaataacgtaactctcagtcttaattttgtgaaaaacttactttgctatcttgatgagtagaagatggataagtttttctgaactttatcaatttacaaacttacattttaggatattctgaagaaattaactttattacctaattttcaagtctaaagtttatcatataatagctgtccttcttatcattatttttgtttggtcatttcttatcttacctagcttcttggttagtaacttaaaggaaaaaatttttacattggcaaatcatattttttgccccacaatttagttacagaaataaaaatggcccaaactacatatatacgtttctagttaaactacacagatatattaaatcacataaacttctggcttgatcagaatatgtgttagcagttagaaattttaaaatattttaaaaatttgcaacatttccatataaacattaccctccccttccagctataaagttaaaaacaaaacgcaactgaaaccacacaattcatcaatcacctaatgtccaaaatgactcaaagtttctctgcacatcaagaagtggacaatacaacaaatgcttcaagtacggttcatgccaatcgtcattaagaatcataacattattgagaaagtacacttgtcctctgggaggacgcttcagagaaataatttacaaggagcatggctgtattataattttttaaaggaaaaatagtttctttggatagaaagaaacagtgtaaaaaatcccctttttaaaatgcagaaataactccattatcaatctgcatttatataactgcccaaaagaatgggtctggaaagaccattttctgtacagacactagttaatctctgtatgaaaagacagcatctggcatgggaacaaacaagggagatactggtctattagcacacatagagactttcttaaggctgatccagtgacgaacctttggatccagaagtatttcttcatttctcttcttttcggctgaatttctagtaaaaactttgaagatgagctgttcttacttttcatttctccacttatggagaagatggaataatgacaccaaaagtactttggtttttttcttttaaaaataatttgctttcttttgcatgccacaggacagatttctagtttcaaaacaagggtacaacaagaacaaaaaaatccccccatccccaaccgtctttcaccaatacaagaaatccttctggaaatattagcaagcaactaaacaggtattgaaccactgaatctacaagttaatacataatctgttatggcagaataaccaagaatttttccccaaagaaagattttaattttttcaaatataaaagtgtctaagagaatcatatgtgaacaaacaaaaatctctgattccagatttttaggataaagatgagtaacacactggcagctgaagaaagctgaaactctgactaataaatagatccaaattaagaatttctacaacagtttttttttttagaaaacaggaccagaattctttttttttaaatgatgatcctgtggaatgcctttacttccatattcacctaatattgtaacagtaaaacagacacaagaatgttgatgacagctcaacaatgctggattcaggacatttacaggtacacttttgtttaaaagtcctacaagtttattgactaaggctagacagcaattcatatgatcctatttggtgcattttctaccatggtccaagatcattacatggatacagccaaggactgggccccaactttcaggaaaaagaccacaaagaagaaaatcaaggtggctatttggtccccccagttgataatctgtgtcctggaactggaaaaacaaaaggtggaaaatacagactgcaacgagttaaaggacttggaaaaagttggtggaaagtggcacggtatacgagtaaggtcactgggcttgggatggcaagggtgctgcattgaaagagcatccacgggaccaagtacttataatgtctgatggtgtcattccctcaacgacttagaatatctgtatgcgataataaatagatcagttatgtaataaggcagtgtgttgaatatgcattcgtcctgtggaatgaaccaccacagagagatacatgataccatacacattctttgagttttcttgtgttgtgtttgatttgtttgttttcaaggctatccaggctaactcttcccggggatttccttggagagaagagtggtccgctgaggctggtttgctttaacctctcctttatcaagagatgatgactggctttaaagaaaaataaagctgaaggttgtttgatttttattttttcccttttggttgcatcattttgagtgttttcatataaacaacaagaacaaaaaatcacaaccaaaaaaaaaaaaaaccaaaaaaaaaaaacacaatagttcttgatgcatccagttgttatatcctcaggatgttccagatgtttccaggtaactctgtagtttacggactgtggttttgtccagcgagcaaagatcaaaatcaaatgttgtgtttgtgatatgaaagtgtccagtttcttctataaggttcacgatctagaggagtgaagaagagaaagtttgggcaatacgcagcaaacatcaaaaggcaaagagagagtaatggaggggcgatcaaatatggaatcaagtgataaatattcgtatttatagcaacaaggtcccataccatgaatagcattaaactgtctcagtcaacttgataagtcaaaggtatattaagccttagaaattcccagtgagaacctgtcttgcttttcataccctttaaactgatgtctgctttcaagtcatgaacagaatatttaactgtgagtgagcagttagggggagatagcatttcaagactcctttaaaaattagttactgactcaatagacagtgattatacttaatagacataagaaaaatccagccgagaaataacaaaactacttttacttaagtacaaacacatacacacacacacccctatataaaatcattttcctttatcattatataattgttaataatttggaaaatacaggaactcccaaaaaaaaaaaaaaaaaaaaaggaaaagaaagaaactgtctacaatcccacccccttaacagatagtgaccagagggggctcaagggagccttctagagtactggaactgttttgttgtttgacttgggtgctagttacataagatgttgtcacttggtgaaaatgtatctacctgaatgctttgttatactttaacataaaaataaaaacatatttattacttttagttgtgttcacttgattcccctgaatattttggggagattttaaatatttaaggtattcaattaaatagaaatattatctagaaaaagaaaggatgcctttgtcttgtcatttggaatagttatacctcatttcttcttgtattggctccaactttcagaaaaatgttaaatgacagagatgacggttactattactcttgccctggctttcaggagaacacttctgaagtctcaacattaagaatgaaggtgatgattggtttgagagattcttttaccatgtaaagtatcttcccattcctattctactaataattttattggacatggatgctgtatctgggcagtgtattgggcacagcgttttttgggggaggcagcaaagttagtatcagggcaataaaagaaaatttgcacagagtaaacagctgacaaacttctacctgatttgagttgtctgttattctctttctatcacttacctctgattctctttaggtcaataatcttaaaaaagagaataattttaattattgagcctatcatttatttaatgaagttttagattacctaatgccacgctgagtaacagcagaactgaaacttttaaccttctcttcttacaattagctttcttttaaaaaatacagtaaatttgtgaactactccctataggtcagtggctcttaatagaaaatgtgctccccattcctgacatattatttgactttcacagaagcatgacatattaactctcaatccaattaactgctcaactccagattgagctgttattgtcttacccaatctctggaactattttttagggatataactacagccttaatattaaaataagctactctcatagtggatgcaacaacagatgctgcaaactaactccctaatatcgatttattccttaatttttttttattaacggaaggccgtttttctgagagctgcccaactacaatgtttgcctccccagacctacttgcagcacttgtcagatgctgctatttacaatttatttgtcagaactcactgttttcaggaatatttctgaaaagggtatggacaatgggtatgcatcttttgccttctttccttcttcctgtgtgcaatgggaatgcagtgcttggaagtgcagcagctgtcttcccattaagaagacgaatacagcttatgaaagatggaagaaaagaaagacaaggagcctgtgtcatcagtggcatcttttaagccactatctcgaccacggattacttacctccaggcttactgttataggtggggagggagtcagaagaaaaccttacttgcttaaaccactagactcaaggttctgttacatgcatcaagaaattcttagaaggagtgtacccaattatggttaaagtgctacatttatgtaaaaatgtatccaacaagatcttattaacactaaaagatctaaaatggacacacatttgttttattagttattagtaacagaactttcaagaagtcttccacacatatccacacacatacagaaacacaaacacacagctatgcccacagaggcttttcatgtcaatcatatacttactatataattaagatcaattgaactaagactatgtattttctggaataatttttttttgccattttgtgcaaaaatactatgaatctagtgaaaatgtgtaaatttcaggatggaaacaagtagtctctttagagctattataatttcaaatttatgcaatggaggcaaataacaagctgaccagaatttgactcctttcctcagcgagctgcccagtaggtaattgacaaagcattcagaatagagttctggatctggcatatcaagttctgactctgcaaactttttcaatggtattagacagaacatcataacctttgagcctcagtttcctcatctggaaaatgagagtaatgctacctgttctacttgtacaagtttgggcagatgatcaaataaggtatcataaataaagcttcttataaatggtaaattgctacctaagtcaggataacatgattatgattaccttataaactgatccttaattatctgggaggtgactaaactgcacatgaattatagacctgatgctttttcctctcgcccccaatgagtgttagccatttcattagcactaaaataaatgaggcaagaaaatgcagaaactaaaactcagaaaggccggcttgaattaaaaaaaaaaaattgtaactcattcttttaagaaaacagttttccacgacccaatatagttgttccctaattatttaataacaaatagaaaactgggcaataaaaaaatcccttctagaaaaaaagccacttaattttaaagcatataaacacttttgcccactagaaacgtcagcccgggcatttctcatgcattgtgctatcttgcagatctccagtacttccatcaccacccgctacctcctctatcaccatgttgtgcccggcctgcagccacacatgcacaacaatataaaggggatctgataaatctaactaaatgagccccacgtttttatgagagcccacaagaatacatcaaggtagatgcagagaaacagccttaaagtagtagcagtggcagcagctggggagttgggaattatttgccaaagggaatggcattaatgatttgaattattagagcatgtgcccacatcctcatttaagtaagggctccataaagaaaaataagtgtgcattgctttccaggaatcctgatagttagaacgtcagaaacaacattaacatgctttattccattgacacaggccacaaagcctgaacacaccccatgagtgcctgaagaactccactgtgcctttctacaggaataccctctttgctgatgcagtgtggcttgaccttgacgtcattactctgcatcatagtgcaataattaacgtctgtccaaaataataataatagtagatagagtgactgcagataagaaaaacaggcggccgggcgcggtggctcacgcctgtaatcccagcactttgggaggccaaggcgggcggatcacgaggtcaggagatcaagaccaacccggctaaaacggtgaaaccccgtctctactaaaaatacaaaaaattagccgggcgtggtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaagaaagaaagaaaaacaggcaaccaggtacatatgggtagtggaaaaggaagagtgtgtaaactgcttaactcattcttcagatgatggttgttgtgaaaacattcatgatggattatttcctgccacatcagcctttcaagcggtactacgcaggctgttggatgtctcattttgttttaaacagggtaagatccacttgtcagatctgtggctcccttccccaatttttaattataaaaaggtaaatgcattgattttggtctgattataatttcaaaaaccagggttctttccatgtgaagcagcctcttcgctgtgtggggagtaatgaacaggccttactttaactgcttctctatggagtagagccagatctgggataacataggtcttcccatagaatggcctctactatggtctggaaagcacggacaaccaccacataaaaatgtgtgccctacccttggttaagggataggccatcaggctccaatctacaaggggtgctgagatatgacaagtaatttcccaggatggagaacatcattttcatcagaacatttctcagggagggttctctgggttcttagaaggaatattctaatacgccacagattccccattccctgcagacaattcgaaaagaatgacggctggcttctaaattgctaaactactctcttaggaaacctggtttcccacagagttttcttcccccagacgtggatgcaaatccaggcttagagctgaattgctggggaggttacatatgttcaatctcactttccaaataaatgtggaacatgtggtttaaagagcaatcaaattattcatcagtcctaggtaatcacttctcttggtttgactgtgtctactctactgtatttataccctttgaaaaagtggcttaggaacacaggctccttgatccaatgctgtctgttcattaaactagctgccgagtgccaggactgcatgcccccagaggaaaacaaagttattaaccgctttttgtgagccaaataaaatcgtcaggccagatttttggataggatgcatttaacaggaaaggacctagatgtgatcctgggcccaccagaaattctgcttcaggtgttcaagtctgcacggcagagaatacgtagactttgtggaatgaattccatgagatgagcagccctcaaggtggagaataacattagtcctcaatagtgctatgttttacaaaaggaattaattaagcagtaaaccgtgacaggacatgcatcatggtatcataatcacaagcctcagctgcattacaaggcaaaaggccaaagactgagagctttcaaccggcctgggaatgcaattagggtgaaatgctgtgtgccctggagtgcctttatgccaggttaaaaattcacagatattactctctccctctagaatactaaaataatccacttggatggagttctccagtaagccacctttcttcgcaattcttataaggtcaaaataaaggacaacattaaattgcgaatgccaatgacaccccaaggtaagatctgcccaatggcctagtatccttgactaactgatagggctttctttgtgaagatgtcccaaccctgcacaaacatctgtcccaccctcctatgagactcactatttgggcccagcttgggcattaatagctttattggacaattgctccacagtggttcagagctggtgtttgggaagagacgagaaagatcatgcaatagatctgcaatcagcattatgccagccccaaatatttggaaaatgacaggtaaaacaacgttcggttcttcaaaagaggcctaagaagaatattagcaaagtactagaccaccactcatggtaggccacttaagtcctgcttccttacccatactaactaaaaagaaactgcaagaaatgcaacttatctgcaattaagaatcataggtctgtagtcttttgttcaaatctaaaattctacaagggttaaaaagcttatcaggccagtcaggaaacttggcaagtttgagagtatatatttatagatgtaagcaaaaatgtacacagaatataaatgtgaccaccagccattaaatgttaaaaaaaaaaaaaaaaacccacacacagctggggtagattaagtactaacgtcaagtcatttgaaagtagtaaaaaaaaaaagaagaaaaaaattcaaacagcgaaacaatctacatgtctgccctggaatttagaacacacattcttctctttgggtgttaaaaaaaattaccaatagctgctggtagtgcaacagaggcatacatcattaactgaatgaaaatgaaaaaccacccttcttatcttctcaaaacatcaaattatactaatagaagtttccccactctacaagtattccactacaagtattccacagttgagttcataataatagaatgtatgtcatacaagataagggaaatgaagaaaatatttattttccttagaatatcattggcaaaggttactaaattgaatcacaaatgtttacaacacttgactcaaattcttatcactgttttcccatgaaaccagaagcctggccccaaagctttttgcatttctactgtcccctccctgagcccacattacaccagccatctgagggatcactacaatccagtatcacttcccaaattgcccagttctcaccatccactgcactagaggagggagaacagttgccatagagctccagagcagacttctaggtggcctcagaaatgagaacctttcccaaatacatctacaggtggcattcgccaggttctgatagcgtggggctgcagtggcctccaggtgctatcacactactgcaggacaaaccaagtcttgaagtttctggaaagggttgtgctaaaaagcatttctcacctgctgcagaatgtgtctttctctcaatgtcattaaccttctgtgaagctctaccagttcatctaggtatgcctgaaagagaagaatgtccccgaaaaggacaagcactttaagtagtagttcaaaaataaatgaatatgtaagtaagaacacacaggcagcagcagctggaggtttctcattacaccactctagcccaggctgtgtgcactcagtgcccaaaggcctctgcagaacaagcctgtcttggaccagtcattacctttatcacaccaacttcaaaaagggagttggagtgaattcttggacttaattgctcttatgaagattcaagtcagtagactcactttcctccaacaatatctctacaaaaggtagggaaattaaatgctaaattgtgagtttaaacatattaacaaaggctactttcatttttttttcattcttgaatctcagaaggtttctaagagaaaaaaattctaagtttgaacatggaaacaagaatgtacattaccaattaagtcaggggaattttgtggggtttttcctgtttgttttgtttttgttttaaaaaggcttcctggtcataccaaacattgctagtaagcaatgccagcaagtgacagaagaacagaagaatgtattacgaaaaacagggatcactatctaattatcatctgatttgtgaagagctcccctgaaaggggagagggggtacctctctttccatatgctcagactcacgagtctttgttagtgtaactgcatgggtgcccccagcaccatttgcgataaaggcaaatgaaagatttgtgaaacattacagaggtctgccctggccctacagagcaaggttagggctctgcccaaaccaggcaacttaaccccaccaggtgttgtagtcaggtttcagaagcatgacgcacactctgggaaagcacactgcactagcatcagatgtcttgctcatctacatctgagattccttaatattctatctctaccacaattctcttaattcccaattcaatgtgcctgaaatcccttggcaacgtaggcatcatggcaaatgacagcataaggccaagcttaatactgaagatataaacaacacatggaaaacaaactacaaagcactgggatgaaatactcatcatttgggcatcttggacactttgatgaagaaaatgaaaggagaaccagcaaggatgatcaagggcaacacaaagaaacggaaggcttgtcagtgttggagccctcctagtaacagactagaaacctaccttgtcacattcaccattctttatttgcttatctgatttgctttgctttattggacttttcacttcaagaatctagggatcaaagagaacgctgtgttaaattttatttcaagcatctcttagctaaccagccacctaaacaaaggcatccactgaatgaaatgtacagtaacatttgctttccaaatagcatttcttttctatacattttccttcttctctctaatcttattttccttggaaaatgaattacttagatctgaaatgctgagtcagaaaagtagaactaaaaaaaaaaaaaaaaaaaaaacaacacagttgatgataaggaaattgatctaagcttccaaggctgcttctcttttgcgacaacactctcaccatatgtatagcagctgagttatacagagattatagttccctctggcaagaatttttttcctattcattctgctgtttcagcatgactactagtgttcagtatgctagggatgataaaaacaaatactcaaatgccctttttagtacctaactttcacattctaaaattactcatatgcacaaaactgatacagctttggaaatgaagatggccgactatcttctgtgttttaagaaatgatgtgtttacccttggtaaaacgccaagtgcttttccttttatctggactgattacaacttaagttatgaatagctttacatactgtatagaagctttggtgggaagctatgtttctacttaataaaaaggagaagcaaattattatttaataaatgcagctgatttctttgacagcatcttcaaaactgaggattaaaagggaagtatttttaaatggtcctcacttgaaaaagcttgaaaccactaaatttataaatgatgagtgcttacacatgtgtataaacacaaaaagcaaagtaatttgtctttttcattataactcattatgaagtgagttgttataactggagactaatattaaaggaggaaaatgccaaataaaggacctaatttatcttaagaggttttatattcctactgttctctttacccattctgtgccctaacttagtaacacttctgtccacaagtttaccacattccgtaacataaagattttaagaatgagtccacttttaatctgtagtggcaagagcactgattaggctcagaagcccaagttcaagtcccagccttattatttaatatttttggaccgcaaaggatgaaatgggagagatgaacaagataagacccagattcccattcagctttaacattttttattactaataaacattttactggatgaggataggaacatgacatcctggaaaagaccgaatactcctgaaggggcatatttttattttaattgagaataatgcacgagtaaaaagtgtccttttaacagtctttcctgacaatcatgctttttttcatcatttttaatatgaagataaccaaatgactaatttgaccaggctaacttaaaatacaatacttttggcaacacaaggaaattacgtattaacagaggcaaggcaatcgtttttaacatgctccactgtaaaggaaaccaaatactccactacattcagaatttcctcctccattgttgttgaaagtgagatctcaagggaaaaatcagcgctgagacctaggagcaagtaggtcagtagatggcactcctcgccaactcagatactgggctgggcatgcagagacaatccgctgagatttcaggcaagaaaaaaagaaaaaaaaagtgcctgcctgcttgacttgtgcattacagaactgaattttgttcccatcatatcccgctgcctcccacgatcccctcctccaactcctgtactctgggtgttgaagtgacttgaggacgctgtatttgcaatagaactttgctaactaggtttagagagttctgccaccttttcttcaaagcagaaaatagaacatttggacgctgaagtcccaccccacacattccgtaagtgctacagcacagaaggccaaaatacattgaaatcctagtttctttcttctgaagttgcagtggcaggaacaaaagctccgggtgtcagtgacccgcctcaagttactgagtggctgcccagagagggctcagttaatcttccttctttgatctctccctgctccaaaataaacagctttgtcaaaacctcattctgagagagctgagccctgctgaagacaattgttttatttatgatcatttcttatctttagggaaacaactccagaataaaaaagtacaacaccttgtcttccacaggcttattttaaaccagtttaactggatagactctttttaatttcattcaacatgccttgcaggctgataggtgatttatgatattctgaatattaacccgggtccaatggatcacttccttccttcaagtcctttctcccctccctccctgccaagcttctggctaaaaaagatgtggtattttgtttttgtttgaaattcacataagggaggtttggagtgaaaaaaccatctctggttgaaatgacgcaacactctttattattacctattaaattgtactgagagaagcagagctacctagactgcctagctactccatttatagatacagcagtctctgaaaatagaagaattgtggtttagtagcacttttgtctttaatctgagaaaatgtcttgacaaacgttcaagattatatttttctgtatcactttatgaagaatgacaactcagttattcacagatggattctctactgatagatctttcatactaatgacagtagctcccaacagtactcaggttaattacttgcttggttgacgtgtgactctatgttcacttttattcagtatgaaaatatttgactccattagtacttcccctcttctctagtccctggaagatttgagaaaaggcaatggacatttcagctttgcctggtgctttatcaaactcagagatcattatcaattcatagagagagaacaggcaaggagtatggaaggaggaaactcaagagtgttcccatttcggagttagtccttccaagtatgttctcaactctttattaatcgtgaaaattcagattcatactctttctctatccctgtctctctccccctacttttctccctccctcctgcgcacacacacacacacacacacacacacacacacattcaaatacgactaaaaagtcattccagagtgaaatttagttgacttttagatttttaagaaatttttactctcttataccatcaacatagagaattaagatatactagtaattttttttaagtcccagaagcttgacttaaagggatagcatcacacctgaccccagtgcaagtgatttgaggggctaggaaaccaatactaaacaaggtttaagaaacctttacttgtcctctcggctccaagacatagctctaagaaggtaagccctcctgtggtatatatatttcctaacccagactagctaaaagtggaagcatacggactttcttaccatgcttacaagtgcatggagaaagtgacacataatacagtattattggcagactgatgattcacatgtgtgaagcaacacttgccaaataaacacgccaaggaaccaggagtatgctacttaatcagataaggtaacttttaccctctccagatagacgatactattcgtttttggttttgttttgctagacaggtaaaaaacagtctgacaaagagtctaaacctttccctaaagccaaggtctgttcaagactgcccattcaggaagggcttaagtgaagccataaggtttgaagggcatgaaaggtgcttgctggagttgcattccctagcaagcccacttttcactatgattgggagagatactgaaggagatgagtgaggggcacaaaagcagagcctaatgccctacactcctggccctgccactgctgtgcccatgacgtattgtagctctcatataccacccactggatacagaaatcaagctgaaatatgcctaggttggatttaaaaatatcatcggctgggagcggtggctcatgcctgtaatcccagcactttgtgaggcgcatgatgaggtcaagagatcgagaccatcctggccaacatggtgaaaccccgtctctactaaaaatacaaaaattagctgggcgtggtggcatgcacctgtagtcccagctactcgcggggctgaggcaggagaatcgcttgaacccaggaggcggaggttgcagtgagccaagatcgcgccattgcactccagcctgggcaacaagagcaaaactccatctcaaaaaaaaaaaaaaaaaaaaaaaaaaaaaatctcaccaaggttcaaattctattctaatgctagttctcactgaagcacaaatttacaaaaggatcccaaattttctagttaaccagtccagtgttctcagctgattggccatgatgcatatgtctttcctctttttactttcctctgaaatgcctgacttgtggtggcaggcatccacaccagaggtaaaagacggctgggccatgagcacagctggccctgaagatggggaagagccaggatatggaaaaagaagtaaataacttgctgaataccccatctataagagataatgaggctggactttgattttaatgtaggacacaaagaaattgcagttgaactgtaactggtacaacaaagagtactggtatcattcctacttaacaagaacggatttgcattatagacaaaccttataaatgaggaattttaaactataagagatctttgctagtgctttaaataaaatgcaaaaagaaaaagtcttcagctctaaactaacattttccaagtaacacaaagaccacggatttaagggcaagactatttaaaattgaaggacacctgtgaaacagtattttcagaaaaacacagttgtttagttttcaagttaatattcgtacagtaacttgaattaagcagttattgtagaggtcataggaaatctgtcgacacaaaaagataagaaaaacttatggtaatgagagtatcaattcaatgctcaatgaggcttttacattattcatgatactgaaaatagtttattttagttggtaaagaaaatatcccgatttaatttatttaacaaatgctctttatcatagccttcaaagttctgcctagatcttatccaaatagttatattttgagttgactatcaaattaataagctttcctttagctcaagttgtaacaatgataatgaccattattttctcagcattttattaattattccttaaaatcccaagtaataatccttctatcttggacgagaaaactgaggccgaacacctataataataaactaccatcaactgagtgccaaggaggggctgtgcactgccttttgctctttacatatattatttgtcatcttcccaataacctaaaagatagtgttaatgtcatttacagataaggaaactgagaatcaaaagctaaaagttaatttcccaccagtaaattaccagtggtaaagaaccaagctctatactaggcccaaaggtcatattcttcctaattaaggcacctacttactgctgaagtgtaaagtatatagaaatcaggagtaaatggtaaatgggcaatactttttgtcaccctctcttattgtactaacttaattaacccatctggtggaacatattcatcttctcatgacagcagaacctcttataccctaactatgtgtttattccacaggctgtggcctccctcccatctatttggcatcaagaggaagtttgtttaaaattcagggatgaaagttttgcatgctttgtaaaaatgattacacctagctctgcagagtcttgcaaagtgcaaaccccacaatttacctggttgttgttggtttttagtaagggtggtggaggttcgtgatgtaggggtgaagaagcagaactgctttcactatcgctgccatcacttaagctaactctgaaaagaaacagacaagttatgcacatcattacaaacagatgattcttgaaatacccatagaaataggcgtggaaagcacagaatccaaacactaacccttgacaagttcattttaactcacagccgctaacacatattggtgcttactttgtaactggaactgtgttaagtgctttacctgccatttctcttttcatgatctcctgtttcacagacgagtaaactgagactcagaaagactgggtcactcatctagggtcacacaggtaaaaatggtggctctggaattcaaatacaagcaagtggcccaaagctagtgctcagccactatactttactggggtcatttattcattcatctcccttctcctgctctccctacctactatgatcaagcatgctactcaagcttacagaaggtcagcaaaattagtttgttgattactacctttattttcctttcctcctccctctctgttacagatgaaaaagttacaaacatgtctagaatacacgctgcaggggaagaagcaaccacataaatgaaacttcataaagaatgtagaaaacagccctgcaccgctgacagcacagagtgacatctaaggattgaacatgtggagcccggcatgctaggaccattaccaatcatttctactgtgtcattattcaaggctgtctctagttctgaacactgatacaacaattcattggaaatacgctacaacaacacaaagaaatggtatgtttgggataaccgctttggaaaactacaatgatatattttaaaaattaaagaactaaagacaatccacaccacctcctccccattttttcttttcagaagaaaatggaattttcttttatccacaataggagagatttatttattctactgtgctgaatgtagtcctccctcagagatgtcctctttccgtatttgctcccctcctctctggttatatagcacctaatgtaatatgcttctcagaaacagaaactgttttagaaatcaggatagtttttctttcactctgaataggcaatcacattctagctctataatgtattcagacagacaagatacaagataggaaatgaaaaggatacactgggacatccttttagcaaaaactgatagaacttgtttttcttaactaaattacattaatgaagtgttcagttgaagtgctgttttaaaatgtgtcttgagtgaagtggaaggctaagtatttaaactgattaaacagttgagacttcacaagtgcagtgaagatcaaatgttacactggcactgacatgctaacacagcacggtcaggcagggaacaagaaaagcagcccccaaaatgtgtatctgtatcagatgactcacaaacctacatgatgaccacacagactcaggagttgcagcaataagtaggtgggcaacaactaatcacagaatatccagatattctaaataacaactagggaaatcatctaaataggtcatacgtttttcatcaactaaacttgagagcagccagtggtcaggattttggttggtataagtaagctactttaagtttcagtccattttgaggtcttttttccctatcagtttcctttttatcagacaaaagacttctaaagggaaatgttataaggccatgggcatattaaagaggttatattctcctatttaaaaggaatgctgacaggttggtctgagagacaaggagagaaacaggggttgaatatgaccataaaaaacagtcactgagatatctaatggggcacacaccctgaggaggctcttttcagaggacaaagcattggcaattaggaagcatcggtctctccagtttgggttaagaccgcttttttttttttttttttttttgaatcttagggtcttctacatagtaatggataacagggaaagatttaatgcaatatattataaatgtaattggattttaaattcaagtagattcgtattttttccactcaagacaaattaaagtaagcatgcctatttgttttcttcatgataaagaaataaaatcctcagggcaatttcaagttgagtattaattataagtgacatgaattaccatcttataacatggaattatgcctcacagcattaaagctacttaaggcacttaattgtcagcacacttaaaaggaatttattttctggaaaacacacaggtgatcctagttttaattaggtcacacacataattcactggagccaattatgtatttctaactacaaacagcaaacacatttcttcaaattctgagactatctccagcagtggatcaacacaaactcttcaaatgaaaacagactttagttcaacagtcagtcctgccacttggcatacttttccaaggacaaggacatctaatgtgactttttcctataaaaatttttagaggaaaagcctctttctgagaaaaaggagaaacagttccctgtaaagtgtgtgtaggcataccaaggagaccctgcatcaaatgaatgtgaccatctactgccgtttttggtgtttcacacctttgctgtgattatcccagcagggcttgtgaaagagtctgacttcatcacaggcaacccctttccttccaagatactcacctgcgacttcggctgcctcctctatttacaggcctctccatttcagagtcattgtcgttatcctccacttcatctgattcctcctcattgtcatcagaatgcagatctttcattatagacctcaaaggacctgagtaatgacaatgaaccacaggcaatcaaacatatactcaaacacacttagccatattagaaacagggggatgcttaccagcactgaacactggttaaaaataatcatcatatatatttatacaatttacaaggcaaatttggtatagtttctaaaatgcaatctctgccaaaacactattgttttcataatggattcccaaaatatttattaaagaatctctattttctaggaattttttttctgtgtatttttcttccctaagaaaaattatacataaaaagaaaaagaaaaatctatcagtaaattgaatgttttgttaggttaatccatgtattgagaagttgagattaataaatcactgtggttgtaacttgttcttggcaatgcagcctttgtgtggtactttttgatccattaaggtttagctgttccttttatttcaaggtcaatttcaggtcaagcaagcatttcagtcaagttcagattataaagtatttcaattccatggtgtaatatcctacctctgatcttcacattgatcttggacacaaggtcttgttgcagcaattttaagcagccaattttcattttactttttaagaaattactggcacaataccagcatgtataaacataaacaagaccatgtaataaatcaggtacacagaaaaatcaggacagtatccagtatcagacaggaaaaagaaaaaaaatcaaactctaattttattctaggacaggacagaaatgaaaacacacacacaaacacaaattcatcagtgtggcttattttcactttactaggctaaatgtgatgaaaaatagatagttttaatcttaacagaagaggttataaagacaatgaagaaagagagacactttcattcgggattaggcaattcctaaagtcccatctatgacagggatatctgagctattactatcttgactccctacaatctcacattctgcaaaacccaaatttatctgcttttgtagtgggcttatttctttggaagtcagtgaaacaagacctctgaatagccaaaacgattactgtcttttattttatttttttcctggaagcttagccttagtccaaacacatacaacaatttaatccttttcaaaacattcaaagccatcaggaattcagtgtggtcattgaaaaaggtaatgttcaatactatgctaaaacacaaattctactttgatacctatgcatttttcatgtaaaaagagtgtatatttgaagattttccacatacacaaaaatggaaaatataattagttaaatattctagtttaaatgtctttattctgaattcaagttaacacttgatcatgagtagagaaaaatatatatttaaaagatagccaattagtattgccttaaagactattaacatgtagaaaaaaaatatgtccaggaggaaagatgaaaacctatttccctatgtcaaagcctcttaaagcttttgctattgtatttcctttgggaactccctgggatgggctgtgtctataatccttttgtagcaatgacaatctgatggcagggaccggaaaaaggggaatttctagagccttgcctcgtacatcagaacaatactcaactgtattcctaagggaaataaatacaactgcataaaagccaagttatgattcgaataataaaacagtataaggtgataaatcaagacattaagatggtttttttttgttttgttttgttttcttttttttgagacggagtctcactgtgtcacccaggctggagtgcagtggcgcgatctcagctcactgcaacttccgccccaggtccaaaggattctcctgtctcagccccccgagcagctgggactacaggcgcatgccaccacgcctggctaattttttgtatttttagtagagacgtttactaaacacggtttcaccgtgttagctaggatggtcttgatctcctgacctcttgatccacccgtgtcagcctcccaaagtgccattaaggtgttttatgagaaaagcatctcctagtttgcatgagatgttgataccttgttgcctggtctgggatggtgtgaagctggagctggagctggagctggagctggcaggactgggttgttcagactttaaagaagaataaaaaggcaccatcaataaatttacgggataccacacatctaaagttgaaaacagtattgttgctcaaaccatcctctgcaaaaaccgtgatgcatttcattatgtcaaattactaacacaggagagtcatgttgtcttttgttgtgcccactgtatttttattagatgcagaaacaagtataaaaacttgaggagataaacacttgggtgttacatgagaaaagggcctggctttgatttcactcctacgtttactgctatacaggtctccctcttttcatcttagatataaaatacttctttattatactttaagttttgggatacatgggcagaacatgcaggtgtgttacataggtatacatgtgccacggtggtttactgcacccatcaacccatcatctacgttaggtatttctcctagtgctatccctcccctagcccctgacccctgaaaggccttggtgtgttatgttcccctccctgtgtctatgtgttcttattgttcaactcttcacttatgagaacatgcggtgtttggttttctgttcctgtgttagtttgctgagaatgatggtttccagcttcatccatgtccctgcaaaggacatgaactcatcctttttatggctgcatagtatttcatggtgtacatgtgccacatgttctttatccagtctatcactgatgggcatttgggttggttccaagtctttgctattgtgaatagtgccacaataaacatacgtgtgcatgtgtctttatagtagaatgatttataatcctttgggtatataccccataatgtgattgctgggtcaaatggtatttctggttctagatccttgagaaatcccacactgtcttccacaatggttgaactaatttacactcccaccaacagtgtaaaagtgttcctatttctccacatcctctccagcatctgttgtttcctgactttttaatgatcgccattctaactggtgtgagaggatatctcattgtggttttgatttgcatttcaaaagaagacatttatgcggccaacaaacatatgaaaaaaagctcatcattactggtcattagagaaatacagctgtctttctaagagataccttgattaccctttctgtaatgttcgattgactcaactggttaaaacatagtggtaatgaggctaaggtcattagttcaatcacactatgagccagttaatttaactgtggcccaaggccatgacccaaccctaacccttttcatccacagttcacaaatggaggccaatattcataacaagacccagacaggtccaaatgagtcaagggaaaatgtcgccattgtttttttgtaaattctctttaattccacaacctattagtggcaaggaaagagtgtcatacacacaccccaatctcttacgctctatgaattctccttatccttttctaaccagaaagttccacatcctctttgacccacccaactcagttctcttccttctccaaaaccactgaaatatagtggaagtatcatgttttcttgttagaggtacaacagtattgcactgcctctgatgtgtctttgctccccagatagtctgtagactgccagcacttgaaaaattaggggtctgtcttgtgcttcttgtaatcctcttgtacttagcataatgcattgtatacaagaggcactttttatcggtgactaaagacggtacattaggccctgcgttccaccttctgccacagtttttttgaaagattccatggcaggtaaagacaggcaatgcacacacatggacctaagtgtgcaaatataccaatcataccaacaaacttgaattttacatatttaaggctaaatttatttcacaataacttagtcatgttctcataaccaaatttatttccatcctatttttaatatgctcatagtcttaactatatatttgagaatatttgtggtttcctgtgtatagaacaaatctttttaattcaaggtgaccaaatttgaggacaaactaagagcacaaccagaaatcactaaatgaggatgagaatctcagtcagtttatatttgtttctcaccaatgctttgttcatctccctttccagcactgaattctcacccccttctcccaaggtagcaccaggctctaccaacttggacacaaggaaacactttattcctaatgcacaattcacatcctcaggcttgatgggaaagcaggtgccagcaatctagcactcattctgcaggaaaagagccagacaggatctctaatgagcagcaggcggcctaccaacccttcagcactgtaacatttacttgagtactgtagcacaatgtcttacacattgctgtttgtgggtcacaaagaaaagttggtttacacgtacaaatgctctataaggtactcttcatttctgttgagtggctcttctactgttgagccccaatggcgagttacacaactgaaagagcattcagttggcatttatgtgcactgcccagctgtaaaacatttctcccagggtttgcagagtactcctcttcctctccaagttgctcttttcagccatgaaaagtgcctgcaaatgatattattttgatagctctggaaaccatctgggagccgaaaaggaggtttccttacagtgagcagagagagctctaattcctcatcttgcctggccagttcacattgtattggacttaaaggagccactctgccagagctatttgctgagaatgatattagcaaggatgacaagagaagatggtggtcatctctccaactaccccacatgaaacattactcatttgtctcaagcatcatgtcaatctcagaaccaaaccaggaggcaggcttcttttagcttcttacccataaataaggttaataattccacagttgctgatcaccaaaaaacccacaaataggaacataacacaacaggaaaaagggctttttattcatcatttatgattaagaccttgcctctgccacaaagtatttgagaagttttacaacaaaagacattaattctacaaggacattaaagtagaaagtttaaagcaaaagagctggataaaaaaggataaaatgctgaagagtgggcaacaaggcaatgtcctgaaagcttttagtagtcaggacagaacaagcatttgtggaagatgagacctttaaaatgatctaaggcagtgaatctcacactttggtggacaacagaatgacaggaggacttgttaaaacacagcctacagccccacccaggagttacagattcagtaggttgagggacatgggtgagtgggacaggaccctggaatttataaagcatcacaggtaatgatgatgctgcaggtccagggaccaaccatgctgatgagaaccactgatcgaggacccagagaccgataatcacagaaactcaacagaattagctgggagaagcctatatatgaggagattctgatttaataggttgatagtggagatccaggcatttttataaaaagctcacaagagatactggtgaaaactacaggatgaggccactgattctatattagtctgcctttcttccttaaacacacacacaaaaacacatttttgaaagaattttaaatttaagaaagcatgactatatatatcatgagaaaaattagaaaaaaattgacttatccagaggcagcttgaaagaacgcaattgccacttaatgaaaacatttatgaagcatgtacaaccatgttgtgggggagacaccttaaactaacttaatctgcctagtacagaattcacctgttaactgctcaaagagccactctgccactagaggaggctgacactgtcttacatttcatcaagcccaaccaacagaattgcagttcactgtgagttatgtattttatttttaaaatgtcacatttatcttccaaaaacaaaccaaggatgattatataaactaaagaaggtcacttgctctacacacacaaaaaaatcatcatcaacagggttatatgaagatctttatatgaagatctttacaggccctaaggattgcaagatataataatctcctttccccaccctaccccctaagaaacattttaaatatgtgcttgtgtctgtatacatgtagggcgtgcacatgtgtgaatgctaaaccaaaaattcagagaagtccaatgaggttctgattttttccccttcttaatataacacctgtttgtaaaatatcaaaattctcaccaccaaaaaaatgttttactacttcttgctgatcctctaaccacatgcttacctgacctactgggtaatgaaatgctatgcatgtagtttctttcaatggtatgttctacagtgataaaagtatagacatcctttgcttcatcatgccatttttccaacaatttgtgttcacttcatgtctctgcatcacatattggaaatccttgcaacatttcaaactttttcattattattatacctgttatggtgatctgagatcagtgatctttgatgctactattgtaattgctttggggacaccacaaaccgcacccatgtaagatagcaaacttaatcaatgttgtgtatctctaactgctccaccaacctgtcaatcaccaactcccttcttctccttgggtctccctattccctgagatacaacaatactgaaattaggccaattaataatcctacaatggcctctaaatgttcaaatgaaaggaagagccacaaatctttttttttttgagacagagtttcgctcttgttgcctaggctgcagtacaatggcaggatctcagctcactgcaacctctgccttccgggttcaagccattctcctgcctcagcctcccgagtagctgggattacaggtgtgcaccaacacgcctagctaatttgtatatttttggtagagatggggtttcgccatgttagccaggctgatctcgaactcttgacctcaggtgatccacctgccttggcctcccaaactgctgggattacaagtgtgagccactgcaccaagacacatctctcactttaaatcaaagctataaatgattaggcttagtgagaaaggcatgtcaagaggtgacaggccaaatgctaggcctcttgcaccaaatatttagccaagttgtgaatgcaaaggaaaagttcttgaatggaattaaaagtgctactccagtgaactcatgaatgataaggaagcaaaacagccttattgctgatatggagaaagttgtagtggtctggatataagatcacaccagccacaacacttccttaaaccaaagcctaatcaagagcaaagccctaattctctttaattttataaaatctgagagatgaggaagctgcagacaaaaagtttgatgctagcagaggttggttcataaggtttagggaaataagccatctctgtaacataaaagtgcaagttgaagcagcaagagctgatacagaagctgcaggaagttatccagaagatctagctaacaacattgatgaaggtggctacactacacaaattttctatgtagacgaaacagccttctactggaacaagatgccatctagagctttcatagctagagagaagtcaaggcctggcttcaaagtttcaaaggataggctgacactctttttagaggctaatgcaactggtgaatttaagttgaagctaatgctcatttagtattctgaaaatatcctagggcccttaagaattatgctaaatctactttgcctgcgctataggaatggaacaacaaaacctggatgacagcacatctgcctacagcatggtttactgaatagtttgagcccactgttgagacctactactcacaataaaagatccgtttcaaaatattattgctcattgacaatgtacctggtcacctgaaagctctgcaggagatgcacaaggagattaatgttgttttcatgcctgctaatacatctattctgtagctcatgaatcaagaagtagttttggctttcaagttttattatttaagaaatacattttgtaaggctataggtgccatagatagtgattcctctgatatatctgagcaaagtaaataaaaaaccttctggaaaaggattcaccattctagatgccattatgaacattcatgattcacaagagaagatcaaaatatgaacattaaaaggagtttggaaaaagctgatttcaaccttcatggatgacttcgaggggttcaagactttagtggaggaagtcactgcagatgtggtggaaacagcaagataactagaattagaagtggagtctgaagatgtgactgaatttttgcaatctcataaaatttgaatggatgaggagttgctgcttatggatgagcaaagaaactggtttcttcagatggaatctactcctggtgaaaatgctaggaacattgttgaaacgacaataaagaatttagaatattatataaatttagtcgataaagcagtggcagggtttgaaagaattgagtccaattctaaaagatctactgcactatcaaacaacctcacatgctacagataaatcttttgcaaaagtcagtcagtccatgcagcaaactgcattgtcttattttctttctttcttttctcttttagacggagtctcactctgtcacaaaggctggagtgcagtggcaccatctcggctcactgcaagttcgttcacgccattctcctgcctcagcctcctgagtagctgggactacaggcacccgccaccacgcccggctaatttttttttttttttttttttttttttgtatttttagtagagacggggtttcactgtgttagccaggatggtctcgatctcctgacctcgtgatccacccgccttggcctcccaaagtgctgggattacaggcatgagccaccacgcctggcctgcattgtcttattttcaaaaattgccacagccactcatatcttcagcactccaatcgataagtagtcatcagcatctgggcgagaacttctaccagcaaaaagactatgactagctgaaggccaagaaaattgtaagcatttctggcaacaaggtatattttaataaggtaatatatactgtcacacttaatagattaccatatagcataaatataacttttatatgcactgggaaaccaaaaacttcacatgcctaattttattgtgctatttgctttattacaattgtctggaacctaacctgcagtgtctcgaaggtatgcctacatatgctgaagtatcttaattctactgcttgatagtatattttggtgaagattgcttaaacattagtttgctcatagagtgagggcactgaacctcatacagaagtgattaccttaaattgatataataaagtaaaaacacctagcacactgctgttctaatggcagctaatcaacatttgattgctactatcatttacaataggtcacatactcctctactgcctaatacaagatatatctttactaccaaaacaatgggcctaccaggatttgcaatacaatcttcaacattaaatggctatgcaaaatcattttgtaatggattttctacagagtattacttttgtccaagacaagtaagaaaaaccacatgtttacaactagaagtgtttcaaaagcgagcacctgtcaaggtagatcacaggggaggcctgcataagctggcactgatcctgtactaagagcatacttcctctttaggtaacagatgtcaaaagtagttctgtcttttctaattggcaactatatttatgaacagaattttggtgacttgatctttaaagcaatcaaaataaaaatagtgaaaagggaaagagtacagtataactagttaaacagaaatgatttcagacacattgctacacttttcataaaatgtaacctcattagttacattacgaaaatgtaacttttcataaaatgtaaacctcacctagaaaaagaacacctagagcctgctataaagattatctcttctttcacaaatatccagaaagactgtggatgaatactaatgaaagaagaaaacacaaatataggacactttatttacttctctgttcaattttcattatgcctgactgaagtattaggttcttctcacagttttggtccttctttcattaaaaaaaaaaatcaccttacacattatatagcttttctttttgcttaacataaaaaaaaaaaccacttaaaagtccacctcatttagtttctcctctgtaggaaactgaaaataatccactcaatttttaaatgtacatttaaaaaaataacataacaagctaggtgcagcggcacatgcctgtaatcccagcactttgggaggccaaggcaggaagattgtttgaagccaggagttcaagaccagcctgggcaacacagtgagatccccatctctacaaaaaataaaaatattagccaggcttggtgaagtgtccctgtagtcccaactacttgggaggctgaggcaggaggatcccctgagcccaggagtttgaggctgcagtgagctacggctatgccactgcactccagtttgggtgacaagacaagtctctgtctcaaaataaaatacataacatccatgccaaacaattgtggaaaaatgctttccattagatgagtgaaatctatgttaccaattcccattaatgggtaaaatattgagatagctatgccaataaaaggtaaggccaaatttaaacaaagaagtattgaaaagtgataaaacaatattctacttatgttaacctaacaatctatgcactagcgaattattaaaagccagaatcaagagaaattttattatcatttggttttacattagtaactgcttcaaaaacatgctaaaagaacaaaactttgttatataaaaagatatataaaaatgagattgaacaaacatcagtaactctaacctcataatgtatttttgtgtagctctatcatattccttatttcatttgcactaccactagtaaggtgagtgataggaattatgccccctctaccctaaaattcacatgttgaagccttaacccccagtgtcccaatacgatagtatttgaagatgggacctttgcaaggtaattaggtttaaaatgaggtcatgaacgtagggccctcttgatggaattggtatccttgtaagaacagacaccaaagagcttgcttcttttctttcttactatgtgaggacacagcaagaacgcagccatctgcaagccaggaagagagaccttaccagattccttgttggacttcccagcctttaaaactgcgagaaataaattgctgttgcttaagacactcagtctactgtattttgttatggcagcccaagctgactaagatagcagggtgcattttagatcaatatttttcagatgataaaactgaagcacacagtaagattaagtgaccgggggtaatatttaggtgaattagaaccggattttctgacttctaatccaatgctatttgtactgcaactattaactttgaaaaagggcaattaatttaaagcagtgttctgaacatactaacacccttttataaattagggacagggaagaaagttttgtcactgcagaagatgtaaggaatatcctttgtccccaaggtacatcttctgatccacacccaaagcaaaccagtggtaaaacaaaacacttcatcccagcggagttaatgtgtctgatccattgcttctaacatttgtccaatcaatattacaatgaatcctggctaggaaccttgttatttcagtaatttttttttttttcttttctttttttttttttttgagacagagtcttgctctgtcacccaggctggagtgcagtggcgcggttctcagctcactgaaagctccgcctcctgggttcacgccattctcccgcctcagcctcctgagtagctgggaccacaggcacctgccaccacgcccggctaggtttttgtatttttagtagagacggggtttcacagtgttagccaggatggtctccatctcctgacctcgtgatccgcccgcctcagcctcccaaagtgctgggattacaggcctgagccaccgcgcccggacttcagtaagttttataaaggaaaacagggaagtttcttctctgaactgccctaatcctcttgagactggcattaataggaccaatgagcacatcaggcaacacagtaaaatcatatattttatttaccttcaagtgatctacgttcttttcctaactcttcaatataaatcccataatatccaagaaaaaaataccatttaatgctttaaataagctgttaacagctctttctttcaaaacaaggtggaaccggggaaaggacactagagtgcaacctttattgctagacacctactcaagtctgtaaccacagagaagactctacatctctttttagtagatgctctccatttgtattacgacaacttgaatgaatttgatgttagattagaatcatatttagcctcttgagttcttatgttatcaaaagctattgttatacccatcattttctgatgatagagcaagatcctgagaattaccctctcaactgttagcaaaacaggaaacgtccttatttctgttatattttcaacttacagatataaaatcatcctggaagccaagataattggcttgcattgaggtgcctgtttttacaattacattcactttcttcattattatcattacctttactattattattaaatgctgtcatttggacttatcactacttgtctgagaatagaaaatgtcattaggaaataaaatggcctcggggagcaggggtctataaatctctccataagacccttttccacacttagggatggctatcattttctttcagcttcctcccttttaagcagaagagcctcaagtcttttatctctcatcaccatttgtactttaaaggctgctacgattgtagccagaacatgtgctctttcaaaaaatccagttgttgcaagatgtgttctaagatcactggctgaaggatccttgttaagagctttgagaatgagaaatcatctgaaaacagaccacttacagtcacaccacctataaacacagtactatttttgagcaaagttcacatgtacagaagttgaatttcacaactgacctttaactacaccacttagttgtgatgccaaagacatatgttttagctgtgttttctctttctcttttgtgtgttttgagagtgacgggtagagaaagaaaaatgttacaagtgagagggctcagagctgtaattcctcacagaagagaaacaggaaggaaaaaaagtttcctgatagaactggcccataattaagtgttattggagttgaccaatgaacatcgaaacaccactacttgtcagtttacaatgagatcttgagattattgtcagaactattcagttacttgtgaagtaaccctcctgtgcagagcataagaaatttaaaatagtggaaaatcacttttgtcttctcaacatttataacggcaacattgaactgaacactgaattgaacaaagtcataaaaagtacattatggctacagggctcagtactggattataaatattaaagtatatttgggattataaaaaagtataaagtaaattaaatagaatgaattcaggaaataaaggtgataatgaaatgaaataactaaaagatatatatctgaagagattattttgacaagacatttaactacatttccttattaactttaaccttttaaaaaatgtgtcactttaaaatgttcataaagcatttgattgacaccaatataatctttacagatttacacagatgtcaagaagtattaattttaatctttggactatcttacagaattttcccgattaaatgtgaaacctggatttactatcatggcagtggcattaagagtttattttatttgctaagaacttatgtccatggtagtttgacttttaatataaccaaaatccactggggaaaaagtgttgacttaagactacctcatcttcaccaggtcaaaaatgcaacattttctcattatcagcttatgaaacaaggactactgatagttgcaagggttatttctctacaagccttatatcttcctcaatagaattagaatactggagctctttcctctatctagatcaaggaactccaaagttctttgggtgtgggtatgaatgtatatgtttacatagatgtgtgtaagataatacatagtagtaaaagaaaataacaagacctcttttcatattagtcttttacttttaaattttcaattttttgtatgtgttttcttgtacataatatgaaagtacagcataacttattcttgtacataatatgttggcttactataatttggaaatgtacatacattggggatacaggtttacagggagagatgagttgtaataccaactctgtaagttttaattctgtaatttacctgctcaaatcttaattatatcacatgatttcaagctctggagtgatacatgctaaataaacaggacagtctcattataactcacacagagagcatccagatttttgtcattttacagtattttataacaatcaaactcagagcttaaaagtttactttttatatttatactgtacacagagttccttattgaagaagaggtaacacaaacttatttaaaagattttgaagtgcacatagcttttcttaaaaacccaacacaaaatactttacataatccccctagaagtttgaaattatctgtggctctattttagagtttgcttttatagtgtttacagaaaattatacaatattaagtgaaattgtttataatcagtctaaatgtgctatacttacattcacttctatttaaaatgttaagtcctaataaaaagtttgtaaaaatatatctattttaagaagtccctctatcttagtgaaaatgaactaaagtagcaaaaacatgctacatttacaagacagccctcatgtgaaaacttaggaggtagattcttctgttgtgttctcaatgtagcccctttaaaaatgtggtattcagaatcacatattcctgattagtaatattagatttctgtccagaataggaggaatgctgctgcttataaggctctaaaggaacctgcatttccatgcacacatcttatataagcctaacagttgcttttcttcataaatcaatctattgttgcacttcataatgagaaggcagatttactgccttttaccgccttttctcaccatcagaaagatgcctatttgggtaacagaacgtttctcttcttcaagggtatttgggattagggaggcaggggcaagaacctttaacatctgctcccttgaaatgaatgacacctctagttctcacagcctggacgttgaaaagcaaatactctaacttgataaaattctctaacttgaagaagcacaacactttaaatacactgaagtcccatctctaaaacatacatttgggatttagaggttataccacaaaactaaagaacacagaatttagattgtcccccaaaagcccccaaatcatcatcatagtgagaacaattggaatttagaataaagacactggattcatcatcttgaattttctctagccctaaaaacaaatctaaattactggctagtaagactttaatcatttgagtctcaatattgtgcaggaataacaaaacagtttgcaatatagacttaacattcctctgtttttatttacttaatttttccccttagggagaaatatttaagaattacaaactttaggttttaatttaaaaacaataagaaggtacttttcagcatctaattcctaaccatctgccttttaaaaatatacacacacacatactcacccattcactccagttaggcttaacattcttaacaagtaagtagatcttgatggatctaaacagaagtttcagtaatcagagtcccacttttggaaacaaagctatctttaaacaggcaccatgactcctactagcaaaagcagttaaccataaacttaaaacaaatagacaccatccaaaacaaataaataaatgaagtgaggcaggtactggattcaagaagaatctctatttttgaagaaaactaaattacatctcctcgttcatgaatatgtagtattgcccagtgagctaacattcttgttacttcaggctatcttttgtcacttaagcaatggtttttgacagttttacaggctgttatcccaaagacttcagtatttacggcctttattcacttgggctttctactcttatccactggttactaatcactaaacagattttttttaaaatgggactgaaattagctcacaggatgtccttcaacaatggcagctcaggacagcaccggtaaaggtcttctcctcagcctcttcctctctctcttcaattttctcttcctacagacaagttagtgagggtccagatccacactgttcaattagaacaacagcacacatgatttacagcattcttaggggatggttagggatcgtttctgaattgatcctcagaaactcattcaatttcaaatatctcaagaatgatttaaaggcctaacttgtttttaatcttcataaaacaggagcaattcctacttgtggaatcattattcaggaattattattcagttctacaaaccttactatccacacacaattgcacgtacaattcaaatatggatgcttttaaaacttcaacacatttagttgtaacctgccattccaatttcttcctatgtagtaaaggctgcttattaccttttatccactacacttaaacaccatagaccgaaaagcaaggagaaaacacagaccgttcttttcacttaatttcatctgacttaaacatctcctaagagattggtttttatcttaggaacaatgtgaaatgcgtaacagagtacattctcttttctagctggctgctggaaacttgaaagtcaaattagactggaaagtgctgttttcttataaactaaaaatgcgaaagaaagccagaaatactgatgttattagtctcatgatcttcctgatgaactgagcaaactgcagaattctctgagaatgggctgagcaatggcaggaggaaggggagagactagctttaaagaaacactaaggctccacttattgctctaaaatataatatactaaatatgactcttcctagaataaaaggaacttattatgatcagcttctgttttctctgaaattgtgctgaaatgaaatctcaaaagaaaatgctccaacaaagtattttaaacctttagatatttccacatttgggtagaagcaacatgttttagtgcatcagaaaaacaattttatcgggattagcattcatatacaacatttacatataatattaactatttggacatcatgtgattgcatttaatttatagacatccacatgacaaattctccttgaatgtagttccaggaaaatttatttctgctgaagaatgtgcacgctttccgatattccaaatataaaactccataactgttatatttctctaggaagaaaatggcagaacttattgcctatgtgtaaaaaagcacctaactctgaacaaatgctgtgttctttaaattttgtaactacttatattagattatatttgccatgtatattaacctgtaaaccaatctaaatgccattcagtcatataactattaaacaagttaaaaatgaaatacatgtacttgcatgagaatttacatagttatatttttaatttaataaaacaacattttaatgtataattaagggctaatttttaccaaataccctagtggttagataacaagggatactctgttatttttctggtaagttaaatcttgcagtgtttacttttatatttaaaaatatgtgaatggagaaaatcattttggatgaacgactttcaatgtatgataagctatataattaagaaaaatgtaagaacaatattattctgaaagaagattcatttcagattagtaaaataattagaggtctaatccttagcttctctcagaaaataagagaaattatttaatacgataatcatgagttaaaaaatgcttctatttctttaacatgcacttaaaaattcactggtagataaaatacttgtaaatgtgctgaagtcagaggagaagggtatcttttttcctactttaaatcactctggagaacaaatgcacactggggctcctattttaaaactttttctctatttttttcttaattagatgaatgcatgttatatgcacattaatcatctaaaattgtaagattttcctgaatttttctatacatcaaaacctcctgtggcttttccttgttccatccctctcaccccatttttcattaccttacataatatcccagaagctatcttgcctatgaaattactactcatagtaaataaactttacatatagtttatctttaaaaattagaaacacagcaagcaaagaaattgttctcacctctttcaaaagaaaacggtgtagccctcaggaaaacagaagtgcccctaagttcatgtgtgtcagcaaggaatggagagctgttaagaatgatcttcttgaaaagaaagaagtctccttaggcacccacatgtatatttagattagactggcagtttaaatgacagcaaacacatggtcatgacttcccaattgctcattcatctaacacatacacaggctaatcagaggcaaacatccaccccgaactgttttagaaactagcttctcccatctgatactactgtatgtgtggtaagcagacattcttctagagagatcggatgtcaaatgcttaactacctctcttagtataacaggatcttaaatcacactgatttagaattccagaatgtttttgtaaagtcagtttgacatcaacttacatcaattccttgctctagcctgcagggttttatgaagtacaaagtaaagaaatgactatgtaaagattgcaggatctatttgtcttatgggtatttttaaactgtaagacctgcccatcctatcagtaatagcacacactcctattctgtaaacagggtaaagtcactatagaggatcacattttcttgtgcaaataaaaggtggtagagttaaaaggtggagatactgaacatgaactttaagcccctactcataatttgagcttcagtaacattttccagtaagtgagaaacaagagaaaacacagatggcactgtttgctggcagctattaactacacctacaacactattgtgttgtatatatgcatacacattgagatttatatatattaagatgtgttggtgaggagcagaaaacaaatgcagctatcagctctatgatggggggtacgttattttaaaatgtcaaacaattttaacataattatattttacttttgacatgaactttgcattttaatcttaatgtcaaatattttgaaaaatctagattagtatgagggtgaaaagaatgaaacactataataatttggtgctcaggttctgaaaacatcaaacctggtttgaatctcagttccaccactttctagctatgtgaccttagcacataacatcatctctccaggcctcagttccttcatttctaatggggaaacataagtaatagtggtaccaattcatatcgctaatgttagaatgttgacaacgcaaagcagttaggacagaacactgaataaatgatgactaaatattagttactattatcatcaataggaataaatataaaattatgatattaaaaagttatgtctgagtccatttggcttgtccaccctctcccccatgatagtcttccctgaaaaacacttgacacttcaagaaataaggtaacttcctttagactaatccaaaatttattttctctgaaacttctcctggagaaggcagctgataaagtacctagttcaatgcccaatatataagacattctagcaaggacttctatacaaacagaataaacaaagatgagaattaaaaagtgattgttaatctaagcacaaatgatctataggtaagaactgcctggtcaagtaatatttgagaattcatagaaaaaagaaagtgaaacttatttagggcatcacattgtttgagaagtttttccttttgcagaaaaagtgggccctaagactctcaagaaaatgatccacttaaagaaaataataatatcatgatactgttcttaacagttcatctcaattttgtagacttatatgcttctgccacatgttaacttgtcttggtagtaaaaagacaaaaacagatggatgctgattgcttaatggcagaaatatttgtctgtagtttttgctactttataaaatattacaaaggaatacagaggtgggccaaaacctcaaacttaattgaaactctctagtgttgtctgacaaattaagattgtaagtcactttattatatagcgtctggtcatgtggtatatcatcaatgccaattatttcttttttctttaaaaactacaatcactacatatacacagttcctgcactcctaagtaagaggttttgttatacatagaagtaagcaagtttaatgtactcatttcctaagaaataagagaattgtcaatgttaatgttatccaaaaacgtgttcttaatgctcagtttgtacctatcattaaaatttaatataatctaacacaattatcatcaatgggatgcaggtgttggataattatattagtatcaacacgacagtcaaattaagatttcttcccatgtgatggagttctgataaatatcaattcattggtttactgaatcctgaagatcaaaaggccctgcatatggcactaataaatcaaatagagtcatcaaatctacagtctgttttctttggctaaaactgcaaagttttacttacagagactgatctacttctaaaaattctctgccaaaccaaatttgactcactaagtgtacagaaaatatagcactccccagccgcaccctcctggggcttctgaagtccagagacactgttatgtggtggtctagattatctggtctttccctcttctttgcctttttagatctcataatcaactaaaaattcttgcagaaaagtaaaaagttacctctagactcagactgaaaagttacaaaatatttttatttattaataaatcctaccataagtaaaggtacttaataaaaatctctaaccgattaacatacacactgaaaataataaaggggtctacaatactttttcctgagtctatttaaatatcggtaagaactcctaaagctggaaattctactcaggtatttatagtataattagtcacgttctgataaactgaccctaaactttgtgtgacagtagtattatttgaaagagaaggggctacggaaagataatgtaagcaatatcccaggaaaaaatcccacttccagttgatttacttaaggagactactctgataaaccatctgttccatgatattttgaatctcgaagaaaatgtacaaatgaatggtaggattatggtgctttttattttcttctttataaaacaattctgtacctttcaaaaatttttacaataattatgtttgaaatatatgaataaaaataacaaaatgtctgtttttggttcaatcgagaacatcctaaagcaataagaaatacttttccaagtccaaaaagattttagaaagacttaataatttgtcctaaaatgttaaaatctcagctgaaaattttggctgacaccactcccactcccaagtcacaacatttaaaaatgtctccagatagtgcccaatggggtggggtaggggagacactatcctaggataatgttttctcaagaagttacctacaagagtctcatataattatataccactaattgacagatgattccattttaataatgttctaatcttaagaccattatgaaatgatacttttggtctgataagatccatttcaatggtctctctctagcattgatgctaaggtgtattctgaagtaaactgcaatctgccttctgagatatttgtgttgcatctctccctttagtgaagaggacaatcactccactctggttctggtgagacagccctgttgtcccttaggttgaaactgaattcccatttccaatgggcactgccatttctgtatttcatatacagaacatgtagagatgccgtgccatttggttaacagggtccaaaaagtaccatgtgaaagcacatactttacataatgttatctgaaatgaaaaagagtttgcaattagagtaagtaaatacaagaatggtgttaccagtcagtttatgtttagggcaagtgttgttctgtgcctgaagtggcacaaaataatgtttcaaggagagtttccaaggcacagcatgttgaagagtaaggagaagggtcattcattcaaatacctctctggtcagcagtcccaagcctactacctcagaagccaataaacccaaagtctgacaagttagcctctgaattatgtgtggcttttccttcgtggctgtagctttgctaaagaaagaccaacaaggagttgatctggctcctgtcatcaagctttgtttggaggcccagtcgctggagtaatgaacattgcagaattggataaagcctattgacagaagctttcagctgtcacagtcatcactggaagtgacagactccatcccatggatgccccaaactcctattctaaagatgtgctggaatgagacagccaagtgaatatgtgactacatcaaatattctagaccccaaaaaattctcagtaagaaatgctaaccggattttatggccattagtattggccagtctgctcctatggtaaaaaccaggctattttctggatatatatataacattctgaactaaacctagataataataagttataggcctgctattactattttatccagatatccactgctctccaatatagaaattattattctaattgtcttaatgtattaagttgacttttcatatccttttcatacctggtaaaattctactattctactttttgctttgtgtgtaagttatctaaatgtttgtattagccacttttccctgcagtcacactagccaaagataaagatgaggacagaaaatacgtctttcttacttcggatcctctatagcaagagttggcaggcttttcctataaaagactgaatagtaaatgttttagccttcacaggctgttcagtctctgtcagagctattccagagctcctcaactctactcttgtagcatgaaagcagtcgcagacagtatgtaaacaagtggcatggctgtgttcaataaaactttatttacaaaaacaagcagtgtaccagatttggttcacaggctgtttttgctgatccctgctccatgggtacttagtacagcaatatcacacttaaagatgttagggatttggtgaactttgttacatcagatttctctgatttagtttatcctattactggtctatttttgtttgaaaacacaattttggcttttttgtttttgcggtcgtggaggggaagcttaactccttcactagctatgcagttttccattccttaaagacactctgtcctatggcagctaaacaattttatcctgcaaaatagcagtgttctgaccttgttgtccaagtttctcagagttactgtggaagacacaattgtgatatattatcctgaagagtgagttttcatgccaattatattgttgaatgtatacaaatgaaagtctcatcaataaaatataataaattactctctaccagatagttcctttgatatggcaacatcttagaaaaggcagtttgagaaaagttacaaacagaattctcaagccaccacaggaaggctatctaaaggtcactcgtttagcaaatgcaactcattgtttcaaaaattcaggtattttaaatggataagttttaaatatctggaagttccagttctataaacagaaatacaggcaggactggctcattcaggagggcagcggagagtgggggttaacatcacaattgccccccaaaaatacctaatcaaatgaaacaatcacctgtgctttatggccaatttgatgtttatgaagatcagtattttgattattacctagatgaaatttttcacactagactctgtaaccaaattgattcttgcatagacctcaaaacaaaaaggaagatcaagtattgatttagaaaatatgtacttgtttcttttgaacacttattctaataaacaacaaaactaaaccattagctaaaaagtaaaatcaaaggttgaagaaatttgaagatgacagtagaatttgtccttttttgtttataaagaaagctattctctggccgggtgcggtggctcaggcctgtagtcccagaactttaggaggctgaggcgtgcagatcacgaggtcaggagatcaagaccaccctggctaacatggtgaaaccccgtctctactaaaaataccaaaaattagacaggcgtggtggtgggcgcctatagtcccagctactcgggaggctgaggcaggagaatggagtgaacctgggagacggagcttgcagtgagccgagatcgtgccactgcactatggcctgggtgacagagtgagactcggtctcaaaaaaacaaaactattctccaaaagaatctcccattaaaaaacaataataaggtaattgtcaaaaacaaagaataaacaggaagaaaggaaaaaaaaaccaccatgattccaaaagatgggatccttcaagacagtttctcacgaaagttatatgccagcatattgggaaaaagagtgatgtcaccaagaataagaatgtgggtgagaccatatagtttatcttgtttttttgtgtgtggtgaaaatattggtaataactgacctaacgtgacattccagtggggagaaaaacaaccatctccctcaacatatatcagaattctttcagccttctcaagatgctctgaagagaaatagaaaattacatgaacaagaatgtcagaaactgcaaatgctgcagtaggatcagaaagtaatgtttcatcagtaacatattatgtaaaaaaacactgaatccacaaaaacctgttttcagccattcacggcagcattattcacagcagccaaaaggtgaaaacaatccaagtgtccatcagccaatgaacagaaaggcaaattgtggtatatccacacaatggaatattactcagacataaaaactaatgaagttctggtacatggtacaacataagtaagtcctggaaatacaatactaagtgaaagatgccaagcacaaaacatcacatattatatgattccattcatatcaattgtctagaacaggcaactgtacagatagaaagtagattactggttgcctgtgattgcctagggctaggggagataagagaattgagagttgatagctaaagggtatgggtttattttggggccagtgaaattgttccagtatgtattgtggggatagctgcacaattctggaatatactaaaaaccactttagaccaggcatggtggctcatgcttgtaatctcagtgctttgggaggccaaggtgggaggactgcttgaggccaggaggtcaagaccagcctgggtaacacagtagaaccccatctctacaaaaattaaaacaaaaaaaaaagccacatgtggtggcatgtacttgttgtctcagctactcaagaggctaaggcaggaggatcacttgaacccaagagttcaaggttacagtgtgctacgaccacaccgctgactccagcctgggcaacacagtgagaccccgtccggtaagggaaggaaagggaaatgaaaaaggaagggaaagaaaaccactttaaatgggtgaactgtatttaaacaaagttgcattttaaaagttacattgaacatatattgacaattgctcattaaattttttcttttcttattttgtccagtaaggcaacttgattcagctcctatattttaaaaggttaaaatgtaattaagttatgtatactttagggcattgtgtagtacatttggcccatcagattattatggaagttcctaaaatggaaacgttatgagaagcaaccaagggaagttaatgatgagtatggcggcaatctttccaatgaactgaagataaaatatgaaacattagccaaagaaaatagtagtagatttgatagtgttacattaagaaggacataaattagaaaaatatgttgagatatttggaggaaaaagtggtaagtttaaatagagatcttaaaagtaggatactaattttccccgagattgtaaatatagttagggctttaaaagcaaaacttaaaactttgttacatagaatgagatctactaccgaaaaagagaaagtagcactaatgtaaaatgaagatggatctacaattgtataaagatcagataaaagcactgatcccaaaataatcataaattaattcctttgtgtaaaacatcagcaaattttgtacatacaaaaattgtatgttattgaatgcctactatgtgtctagaaatgtcttagcacactggacaaacagtgctcaacaacccagatatgattcctgaccttagagactttggagtgtattttattgtttaaagtttaactgcctttgcttcaatatttcacatataccaagaactctggcaaattgactaacactcttcaaatatgaaaactacaacttctccaaaatacttacataagagggagcattaaagtttctttttcaaaagctgagttagaagtacaaattaacatttggagaaacaatttccttctataatagtaagacaaatcagatatcttatagattaaattgaggtgtgccaggcatggtggtgcaagcctgtaaccccagctactcgggaggcggaagtgaaaatatcacttgaatccaggagttcaagacttgcctaggcaacatagtgaaatcccatctcattttttgaaaaaaggttaagtaagcaaattggggtgtgatttacatgcttgcatgtagtaaaatgcacaatctaggcatacagctcaattaattttatatatttctacacccatgttactgccaccagatcaagatacagaacagttcacctgttggcaattttggacaacggtttgctaggtgatttgctggatttcttgcttggtcctaccaactcccctggggaattgggtagaaaaaaattttaaggcaactcaattgacatcaatcaatcattttgtaggaataaaatcacatctaagtgactgattatctgtgtttagaaaatccttgctaatttctaggacagggaaaagcagagggaaaaagaagagaaggaaatggaacaggtgcctgaagattgtgatcaacaaggtaaacaagataaggtaaacaaggtagtaacccagggggaactgtactcattcttcccatatttattttgtaaggaaggctgacagtatgagggaattattactttaaggcatgaaaccagaaagccctcaagctagatctaataggcaacataaagtgagcctaggcggatcaaagagcagcctgaaacacagggaatcatcatctcatctcacctatccatctatttatttactgaatattttcatgagaaaatatgccagcctatgtttatctgttcctgatccactttccgtatttacctcttgtaaatctaatgttattgcatttaatattacttccatcaactaccatgtttttcctaaaacaagacaggttttaaaaatacacaattctttgtcactatcaaatgtacttctctcaagcttaagttagtagaaggaagatgtgtatgtgataaatgtcgaactagcagctagaaattatgcaagtttgtgaaagttaaggttttagtatgtatctatgatttctctaattttattttactattaatataataaagcccaggtgctacataaggttaaagacagaaaacaactaaagaaaaagacaaaactatatggaagtcaataggctttctaaggagcgtcgtatcactggcggcttgccacaagaatcagctcaccttgtcggtaagcgggaacttcaccggaaaaatatccttcaatttgcttatccgaggcctcctgagctccctgagttaccaagaagccaaatctactgttaatcagaacactctaagaaacttctaagagcactacttccaaaataaagataattactatgtgtcttcccaatctcacttcctcaaaccatacctggtaattgtaagaaccttcagggtccagagattgccctctgaactatatttctattttgtcagctctttaaaatgtgacaccaaacataaggcccagatgcagtctgacgggagaagatgatagaactgtaatttgatatgactgacatacaatttttctattaatacaatcttagattgaagtagcttatatagagctgacaatctactaaaatccccaagatcctcctcatctccatataaactgtctctaaggcccatctcccttttcctttactaatcaaaataattacttaattttaaatgaagaaacttatatttatctttgttaaatttcactttcttgggtttaccctagcatttctactcgatgagaatttttttcttataattctggggttaatgaatacattatccctcccagctttgggttactggtgaacacagcttccatatctttatgaaatttgcaataaacataacaaataggacaggacaaaaggcaaagccctgtaaccctctgcaagagatctctttacaggctgacatggactctttaaatgcatttgtagagtgagtacaaatccatccatctcaagaatcaccaggtcctcttctaccttatcctaaggtatcattaaaagactgatgacctgtaatcccagcactttgggaggccaaagcgggtggatcacctgaggtcaggagtttgagaccagcctgaccaacatgataaaaccctgtctctactaaaaatacaaaattagctgggcatggtggcacatgcctgtaatcccagctacttaggaggctgaggcaggagaattgattgaacccaggaggctgagattgcagtgagctgagatcatgccattgcactccagcctgggcaacaagagcaaaactccatctcaattaaaaaaaaatgctgatgaggatgagccattgcattctctagtcaaccttataaaaaataaagaaattaggattgttaggtataataaccaggtaggacctagtgacagccacagtcttttccaaatgttccttaactacgtatttcaaattcaattccagagtttactgggaaacactataggacttaccaatcggcaatttctggaatctgaggatttgtcaggactactcatagaagattatgctcactttatcactggatgctgattgttgcatttcaaaggctaaatgctcacattactcacttagaacgctatctttaactgtagcactatatcatctacagtagaccttgctataaagatttcccttcgatttcaaaaatattcactgatataattaaatacaggtctgaatgttttaggttacatgctatgaaaaggtcagtgcctgaagactgtaaatatgtgcaatgcctctcttctttactccaacagctatgccttacataaccactttttattgcgtgataaaagtaatgctagttgacagaggagaaaagtcattattggattttttcaattatgtagtaattagtcatgcattttttaagtgccaatctaacaagaacaggtaaaactattttaagagcatagaaaactaagagtaacaagagaaagtgataactgtaacttgagatatatttataactagcattaccaatttttaaacatatataataaattggttctgattatttgatacttgtcttaaaagtacttcatcattgataagatttatcattcttgtaaagcttcatatctaaaaaagatttacagtcattttaattatccttcacaacaactctttcaaatcattcaatgccaccatccctgattctgattctttccatatgaggaaaatgactcatatgcagtttatagaattttcacctgtacaacacagcaaggagctggctggattctcatataggcttctggatgcaggctgagacaccaaacacagacacccaaagaaaaaggtccagggttggggggagcattgagggacaggtacctcctccagaattagaatgaagctttcgggtatttgccacttacggaggcagggaggcagagcagttcttccgatctgaacacaaaataagacactagctgtgcaaaaagaagatgagccgcagctttaagaaacccagctatgattcttcctacctagacactgagccaattagtgacctggccctgagttagagaattaactgtttaaggctactacagtgtcttagttctgatagtgcagtaaggagggggcattagggatggtgataaggtaacttaactcaatattcccactaggtaaatttggggtccacaaaggagacatcatgtctgggtgtacaactttactatctggaggcaagaactgatctactcagaatatggaactagttgtaacttccaccacagagatatcaccttttctgggggttacctttagtcacaaagtgttagacactggctgtaagatacactttgtaacaaacatggaacgtatttttaaactctttctcagaaaagaaaataaggaataaaatgctggagaaacagtatggagaaataaggcttccacaaaagaatgacatgccagtaaacaggaaatcttggcttatttcaactttttaaaatgggcccatttaaaaagctgtgcccaccctcccccaccaacttcttttttgatggagggaggtgtgggaagaggtttccgtccaaggtgacccatgtgagagaagagcaggtgaaagaaaggtcccacaagagtaaggaaagggcgtaatctcccctatgttcaatggtcaccacctgtgaagctaagcgtcagaggaactaaaccatagcgtctcccaaggcaacagatggagcaaatgaattagtcactgcccttcccaggatgctaggcacaaagcactttggagggaaggtggttaagcagcgcatcctgctgaaacaaacctgacatctgcttaatcttctcccctggcctccaactccatactgggtatttcaaatgggtaacaacttgaaagctccatgtggacttctctttcattattattatttcaaacgctaaatgttatctacttaggatcttactttggcttcatgccctggcagaaggcaagattttttagctaataagggcctggaggctttacaagaccacaggagttttcaaaaatattcctacatattcataatagtcaaattaatagatctgatgccagatgtaaagtggcattttatgtgtagctttaaaaggtactaatggggtaacttttaaagctactttaaaacatgcagctatgaatctaatgcaaaactgtttttgcctttcatgttggctatgtgtttactgctctgtaataaactcatcagaaaaaacttggcatctttctccctggatagatatttggcattcaggaaagaaatttaggttaaacaccttttagctgtcctttcagtaataattaaaagcttttcctttgacttagtgacatggttcacaaccacatataatgaaagcaacataaatctttcctgtgtggtacattacatgccctccgatagattaaaacatgccagccaagtctgcacttttataggctttaagctgttgaagagccaacaaaagtactgatggcagagcatcaggtaaacaggatgaaggaaaccatcggtaacaactgtactgtagaattttctgaatgcaggatcctgtgttcaggacagcataggcttgttcttggagaaagcagaatccctacctttaaattcccagttctattcagtagacaagatgaagcataaaggcaaaagttaactaatacatacgaatacagcatctataatggcaatgtcacctcatgaacagaaactatcaactaaaaggataaaatgcctactataaaccatattttcagggttttttttttaagagaaagtcatctcttttaacatcttgtgagtagcactttaaactttgggaactcttttacacatatagtccccctaacaatatgtgaagtaaggcatggaaagaaggaaagagggaagacagaaggaaactagaaatattcaggttctactggaatttacagactaccaactatgtgccaggtactttttactaccctttgattcacacaattttgtgagctattattcacatatcagagattataaaattaagattcaaagttgttaataagtattttgccccagatcacagagctagttaaactgtcagacctggggccctttcccaggtctcaagagtctttctggggtgttagtttttcaattggtttataaaacacagtttgtgttcctcaccaaaatatggacaatctgcttgcctgggcccaaagtgctatggttccaagcagattcctgcaccacctggcatatatttacaggagcacacaagttcagaagggaaatgttggtgggcgtagatgccgtcaaagctgacagaatctacaaactcatctagaaagaaatgcatgcaggaagtgaggtatgtatgacactgtcattgataaaatggaataatggaagaaagaaaaggcaacaaagggtgttgttgctggagtaaggcttatcctaactcaaaaatcaaggaaaaaagaaccacaatccaaggtgaggcacaatcaagatttctggctagtggagatctgtcaggtgaaagatgctagaactagttaaacacatacacacactttaaatattttgctttaactgaaaatttataaatacacattaatcaaccaatcctttgatgcagaatcaagcagttttcagtggggtctgaaaaatctttcttagataaatcacactcaatgcattatctacgatcatcatttatgagcaagaagccagagacttgtatagctgttagaacgcaggagtccttctagagtctgataattttttctgccttggtgttttataccttatttgaaagcatattttttcaagggattccccatcaggtttcaacttagttttcatagaaacaattgctttttgtacattattggtttctaaaacatttaattaacataattagaagaacaactgatacatatctttgggaacaactacattggcttctcagtgagtataacgttcaacttttgggagcagaagtacacagtataagctagcacccaccagcgattggcaagagtgagtatgcttttcaggcgattggagagaattgttatcagtgcaggctcattacttgagcttcttttgactgcggaacatgtagggccctataaaagctgggtagaaaggcagctctgcaggacccatcagcatgcaaattacaacttaggggatctccagaagtgaatacaggaggcaacccatcaatctatatttacctaagttttagggtgtcttaataaggtttcaaagtacatgtgctgaggctatgcctttccttaagaaaacagaaggttgtgataacatcttcctttctaaaatgatgactgctgtctttagagttcattttttttctcttaataatctcagcatcccacagtgataaattatatttgggtataatttttgtctcatagatgtaatggctcttttaaaaccactcttagaaatgctacagtgtatccaatgaatataattaaatatatatgtatttccaaatacaagtgccaacaaagacacaactaagaccctaatttttaggggaactaacttcatcttccacatcttgtttctgtcactatgctagtgttcaatataactctctttcacaatacttgccccttttagttagaaacttatatcttttgcattttttcattcattcttctgcatatacaatgaatatttttaatttttaatttttttttatttttagacagggtctcactcaggctggagtgcagtgttacaaggacagctcatgcagtcttgaactcctaggctcaagtaatccctcacctcagtctctcgagcagctggtgtgtgccaccacactcagcttattttttagtttttttagagtctccctttgttgtccaggctggtgtcaaacggctggcttcaagcagtcctcctgcctcagcttcccaaatgttgggattacaggcatgagctacatggctacaataaacatttaattatacggttgtagttactcagatgtgatggtttaataaatatttaacagccaaattaagcttattaatttaaagctattctgtcttgacaattatgcaacctgaggacacagaaattgggggagtgggggaagcaagtcccttttacacggtatacaaggggcattttacccgttccaataatttcaagagcactgtaaacattagagggaatataatcatatttcacgatcacaaagacagcaaaaacaaggtggccatataactttcatgttatcatgcccctgcacagcccctataggaaatagggaggcagaaatttctttcactgcaacatcctgttattgaaatttctctgaaaactatttgcttttttaaaatagagaagcaaatgtctcggaattttagactctgacatccctctgctgtctcaataaaagattagtttgtggtccttgctgcccctgtgttatttttgtggtttaatacccttcacggtgaaatcagctaaaaaacaaacaaacaaaaaaaacaactctcttctctttctgttggagttttcaagagctacacactccttggctggcttatgtactccaacacaaaggcaaggggctgcccgggcaggtaagagtgaaatccaatttatgcaacttgcttactgtgacctccaatttatcctaggattttgttatataaacttatttgcataagggtggcttacaccctgtactgtgtacctctgagagggccaagacttgtcttatttgtacagggagttctctcactcatgtgacctgtctagtccacctccataaagaagacagaccaaaaattccatctccagattacacagacatatttatagttaagactcctcgactagacatgcatcaattacttaagaggagtcttaactataaatacatacgcatatattaacacatctttgcactattaaactcaatatttgttgagtgccaattaagagccagggaccatgcaaagagctgtgagattagaaaattaagagacagggtctgccctcaaaatagtccactggtcaggagaaaaacactttaatatgacggaaaaacaatcatcatccaagtatacataaactgtatacatggtagatgcacaaaggagggaggggttagttggggtgtggcagattatttagaaaagtttcaaagaataagtgaaagttaaccaggtcataaaggactcagggtaatatactgggacatgagacagcatggaatagtcaaggaatcatggattgctaatattttacgatgactaaagtataggggagaagaaagaaagataaggatgaaacggtcagactggagaaggcttaaaagcagtacttaaaatataatttgaggcatgtgaaactgttcgaggctgctagggtaccaaagtcattcttttgaaaacaaataaatggaaagaatcaagcactgtgttttacttttctatacaaactactgctggtttggggggagaaagtagataaggggcagtttttctttataggtgaactctgacagataaatgaagaaagaacgatggaacaaaaatatcagcatttcacaatccctaatgaattaatgcttatacagcaatgagcatcaatggttgctaacatcattaaaaaaaaagagataatcttacattataggcctcctaataaaagaatataatctacccatgagatggtctggcccagaaaaacaaaactaaaacaaacaaaaaaacctaacatgactctgaccatgattctaactttgactattgacttacagaaaatacaccatgaagatactgtcaacaaaatccaaaaccagaaattctatgacaaccaagtttttctcctcttgcatcttcatgtgaaaaaagagagatgagggagaacctatagattaaagaaatgtaatacttttacaaattgcaagatgtgaactttatttagatttcaattcaaacaaaatgtagagaaaaaaacttacgatattttgattccattggaaatttgtccagtggctagatatttgatgatattaagacttaactaattactttagatgtgatcatggtatttagttctgttttttaaaaaagtccttatcttttagagactcatattaaaatatctataaatgaaataatgtatcttggatcttattaaaaatcataccaggctaggagaagatggcactacacatgaaacaaaactgaccatccattaataattgttgaagctgagtgatggtccatgaagggtttactattttgtgtatttcatgtatacttgaaaatcttcataatgaaggattacaaaaagaaaaaaaaaacatgttaaagagaatttggtacttagtccatacaagtgctgcagttttgaaactatggaatgtttcattaaactgccaattgtgaagataatattttgaaagtgacccataacaccataattttaactagttgatttatatccttttgcatattttcttctagaatttgtattttagaaagttttgtagagaagaacctgagaaaggaaagagacaggagataggaagaacaactcaaaatctccaacctcaattgagttaatgtgataagaatccaaactaagcgctgaatagaagaagcaggaggaggagaaaaagggagagtcacagacatttttggagcaaacctgataaggaatcataagcaaatgaaataagatctgagggaaaagaaataattttcacagcaccaatcactacctaaaattatagatttccttttacatgaaggtaaagctctgctcctatcttaagcattgtattatccccagtgcccaataacccataatagacagtaagtattttttgaaaaaatatgttaataactgattttctaatttaggttaataaaaatagatggaatatatatttacctaattagaaaacacaggaaggtgttttgggataatgggtacagctaaatcagttagggagtatgcccacctggcactaatgtatacatcatgaactaacattgtttttttcattaaatgagaaacccagtatgacagacaggatcagcatggcagctctacaaggtcaagaatcaggaatccagccccttcctgtctttgtgttcctccatactttccatatgcttctaacaacgtggcagctagagcaccggtcatcacttccaagttccagttccaggcaagaagcagaagagggaaagacaaaatggtacctaccagtgagtcagcttctttttaatgaacttccctgtaattcccacctaataactgccatttatatctcattagccagattcagtcacagaataatgtctaactgcaaggaaggctggggaaacttttttgttaggcatgttactgttataataaaataaacattctgttagaagaataagaggataatggatattgaatagataactagcagtgtctgcaagagatactttagaatatgttgtacctgggtatctgttctgtttcaagtacctgttgatcagaattgtccagttggtagcttttgagaatagttggcgttgaagaagatgtaaaaaatatattggtaacaggtgattgtccagggaccgactatataatagaaaaggagaaactgagaatggctaacttaatggtggtagaggaaggtcagcaggtaaaggagactcacacagagtgagatcaaggtaggtataacagagtcaaggaatcaagcaaaaagtaagtcaaaagtgccagtaaagtcaaagtcaatgcttaggacatggtttctacattaggatctggaaggcactagtgaacttttccagcggtagttttaagaacagtttcaagagcaaaagccagaccacaatgggttgaggaataagggagcttttgagatgtccatcagagaaagaaaggatatgaaggtgccatagtctaaaaagcaccagagttcactggaaagttgcagggaggtatgtttggtctgaaggatgactcattatatttgtagatagactaagaagaacaatccaggacagagtcagatactgaagaacctggagggtggaacggaggaggatctgggtttcgtccgctgagaacagcagtttgtccaagtaaaggcttcatttacactggagtttttaaaacctctttccatgtttttattatgaaacaatactgagacttttgatttgccagatacctaaatgtgtcattttccgttttgcctagtgatttttttcccccctgaaatacatcaagtcatgattattctggttggcaatatcccagagacaataaaggatgaccaggacacaaagtctatcaaaattctcaccaattaacttacatgacatcctttgggatttgcaccctacccttttttagacaagacatgaagcactgcaggtggaattcagctggggatatgggatatgaggttcattcattcaacataggggcacaggctgagatgctggaccaagaggtcacattggccgtacgcctgacaggcttaaataagtgtgtaagggctagtttttaaatggtaacaactcactaggaaccactttaaaatgttctagaggaggagagtttgggaaagtgagtgaaggatgtgcgaatcactgcaaactggaaatgatcgataatggcatgccaactgggggcctgcatccgagggcccccttttaaaaaaaaaaaaacaatgagacccctaggatcttgggcaagttattaaacttggcttccagttctcttctgcaaaattcaagttgttgaatgagatttctgaagtttcttgttctaaaaactctgtgattatctaactcatgaaataaatgctgtataaaactgtatgtgatttctaaatttggtcttaaaccttcaaaaagagtacctaagccttgagaggttttctaaatacagaagagagaccacagagctgttaatgtatctacaggcccaatgaagataaagagatgggtggcatataacacacaacctccctccttcaaatcttgttttttggaggaggtaaactattaggcttattggtttattatacaaaacacagaggactatgcatgacttatctttaaaggggaggaagtgacttgttacaagtctctgaaagttgatagacaatgacaggaggcttggtaaacaacagtaaatgtgctagccctgtctgattcttaactaagatcatcagataacttagcactttaaaataacccaccacaagatcaacaagtctgaggctcactttaaattaaaataacgctgcaaaataatgtgaactaggacacgtgaaaatagagtgaatactttatattactaaaaatgccctagaaattaggttatcttgagtagaattgatcagatactaaacttttttttgtttttcagaaacagtgtctcactcacattgcccaggctggagtacagtagcacaatcatggctcactgcagcctcaacttactgggctcagatgattgtcccacctcagcctcccaagtagcttgggactacaggtgagaaccatcacacccagctaatttttgtatttttttgtagagatgagatttctccatgttgcccagactggtcttgaactcctagactcaagttatccactcaccttggcctcccaaagtgccgggactacaggtgtgaaccaccgcgcccagtcagatactaaacattttaaactaaggtggactttgagaaagattctgcttttattcccaataaaatgaagcgttaggccaaataggaaatgacgttttagaaatatatgcaagaataaaaacacattctgtgatcatggattataaatcactaggttcctagactgcagttttgcctcccaatctttacaagaacccctgccaacatcaggtcttcacataatgcaattgataaaattacctaacaaaagctgtcttcatctatgacatcattaatattttgcttgaactaatacctgaatggcaatttgcatctataataaggtgagcattactaattattaaatccacattttacggctctctactacaaagctaaacctgtttagttttagtttttgattttgaaacggtctcactacattgcttatgctggagtgcagtgatgtgatcatagctcactgcagcctagagctcctgagttcaagcagtccttctgcctcagcgtctcaagtggctaggagtacaggcgtgcactaccacgcccagataatttttaaatatttttgtggagacatgatctcactatgttgcccaggccggtcttgaactcctggcttcaagcaatcctcctaccttggcctcccaaagcactgggattataggcttcagccactgtgcccagcctgtctagtctttttattccaagtgtagactcttgtaccacacttcctggaccactcctcctgagcccacaaagataattgactggccaggtatggctatgttcctgaggaaggaaggaagccctaccttccttcctcagatcctccatgagcgcaacctttatttattttattataatttttttctgacataatccacccggagatgcatgagtgcaacctttagataatacaatataatatcaatacaataggttggagccctcgtagtaacactggccatgtccttggccctagaaatgagatatatgaaacaacctaataacattagggaaaagttccctcagatagactctaaggtaccacagcttttcagtactttctgcaattctgcttctcagaaaatgatattaggttacataaagcaagactcaatcagcattttagaaatcatgccagagtccattactcacacccaagtttccaagtactgtggctacattttatttcttactcttcccttttcaccagaatgtggcaccactaccagatggtcagaggatgtcagatgatgggaaggttaacagtactaaattttattttctcaaaagtgtttagtcaatatcacagtggttttaattcgacatgacttccctctgaacaaggtttaatcatcagtggtacaatacaagaagcatgaattttggcattattcagacctggattcgaattcttgctctgtcacttccacctgtaagatgagaacaaaagctatcttacctattgtatagattaagtaagaagatataaaataaaagagtcccacacaggtctaccatggagggagtagagttcaataaggtttctttcattcccagtaaaccagtttgataaattaactgcaggaatttatttatgagattcttcttcattctcagagaggataacacaaactatttacacaatttgtcatcaattgtttgtgtttttttccaagttgtttcctcttatcaagaatgccttctggccgggtgtggtggctcatgtctgtaatcccagcacgttgggaggccaaggagggtggatcacctgatgtcaggagtttgagaccagcctggccaacatggtgaaatcccgcctctactaaaagtacaaaaattagcagggcatggtggtatgcgcctgtgattccagcttctcgggaggctgaggcagcagaatcgcttgaacctaggaggcagaggctgcagtgagccgagattgcaccactacactccagcctggataacagagtgagactccacctaaaacaaaaaagaaaaaaagaaaaaaaagccttctcctgtacccccagcagcttcttgggaggctgaggcaggaggatcactagagcccaggagcttgagaccagtctgggccatatagcgagaccctgtctcaaaaataaatagaaagtcttctcccactgaccccacaccctcatctctactaattcatgcctctttccttcaaagaccagctcaaattctaactttgtactatctggaccacctcatgcagtgaccgtacataggaagtacctaccacatacatatttttaagcgttactgaacattattagagtaatgaaagaatattacaaaccattaaacacatctagaagaaaatgtttttaataacttaaagtgacatgatagtttatcatacttaaaaaaataggagtgtcacataataaagcaaaggtcagcaatttattgtttaaaaaccagtaccgtgattctaagcactgaggtctcaaaccagggccactctagtaatttctttctttctctatttatttaaagtaatacctgagggacccatatatgtattttccttctatgaccgtgaaaggcaagaaaattaccttttctgtgtcacagattctgaatatttcttcctatccctgtactcccacatccctaacctctatattttcagaattcaaagataaaagtgttgtcttcaaacattttagtaaatgcttctccatattatcctgcttaatagcaggatctttgactttatctgggaatatatcactgcacaatcacctttggtgacctaaggaagctgcttaggggtgatttttccttgtggaccttgacactgcttgcaaagtttacagtcataaattgtaaccctctgagaacaatttctcaaacttggttaaataattacatagacaccaaaagaaaacaaccctctgtctactcctaccattgcattatcttgtctcctaattcaaagaaagcacagcctacattttgaataacttagagaggttataacatgaatttacaaaatgtaactaggaaattcagaaaggagtctccaaactggaggacaccatttgttatttggtggcatcttctgggaaaggttgatattgcagctcagctctgtgaaacataaattctcttgcaaaagcacatgggaaaaactctggaaacagaaaaataatcctgatgatatagtataataaggtgcaatctagacccaagagagtcagttttattttaagtgaggatgtgtaagaagctagaggctcctggatgtttcacagctcttccctcaatcctggctctgcatgccaaatccacctatgaggacaacctgtcacctcctgaaggccactggtaaagcccaaaccaataggtcaaagaaacaggattcatatgggggacaacatgagatattcaaggctttcccagcagcactgccaacttcatgtagcacacctctacaattttagtatgaatccaaggaagaataagatttgttttaccaccaacctcctcttaggtaggtacactacctatcaagtgggttcaaatcctagctccatcacttctaaagatggcaaccttggggaagattcttcatcttggagcctcagctttttcatccataaaatggcaataataataataatacctatttcacagagctgtctcgaggggtgaatgagttaaatcatgttaagtacatagaagggtgactaacagactaaacactcaagtttagctatggctataaggcatctctgtggtatggtaatgctagtcttgcaaagcccatgttgagtcccattgttggctttatgtctaaagatgacaaatgggataattccatcaaatgcataggtcataaagcaagaaacaataatgcattgaataggtgatgtagctctcttaaagaaggctcacagaatttattggaagagagattctggctcaatacatgtcagtggaaatgctgagttttgccaattgttgatgacaaccagctttgcaaagatagagcccctgtgtattcacaaccttctgctacccaagggcttctaaggaattccttaatttaagaactgagataccacactggccctagtatgtactgaaacacggaaacaaaaaggcctccaactgtttttttttttaatctcctttttaactgcttttttcaaataaaccaggaatatggatgaataaatgaacagctggttggcaaggctgcctcctcctcagtgtgatcacacccaacacagaaaaaaaaaatgcgttagaaaatagggacaggtgaaacatctccatgcacccaacaaagttaacttttgtctggtaatttcaattaatgttccacattgagcagaatttaccagaggaagaactgtaaccgttcaggtatttttacctccagttataaaacacagaaaacaggagcctccgatgagaacctgccccctggagagccagggcagccctttaatgaatggcctctccagctgctccctcaccatacttacagactttacagctcttgcatgtgctggaattacaagtcattaaaaagccactttgaaaacacaataaagaccttcttctctgactgcaacaaccttccatcacataaaaacctaaggccaatgcttcaacagcaggacgtttactaccagctccagacagtttaagcagggcaatgaacagggtggggcgggaggaaatgagaaacaacaaaagaagggaagttttttttttccttctttctttttgaaagaaatttctggtaaggtgatttaaagcatttatcctgcatcggaatcaccatccacccttgggaaaaatgctgccaactgatgagattttgtttttctccttcaagaaggttttctccaagaaaaccccttggtaagctccaactatcaaaagacatgactgaaatctctcttctcatgctgcaggctgaaggatgtaacattttgccaaatgtaatttgtccattttcagggaaagatcattaaaactttttacttcttcactttaaaattatgattaaatcctcaaagtaaggcaagaaagaggaaggcaatgataagaaaactaccaccataactgaatctgatcatacgtggttatctcaattttcatttactgtttttttcctcctctgctgtgaataccaaacttcttcatatcagaagacaagatcaactctatacacttctcttcaggagcaaaattatatgaaaaacaaaaacaggaattacagaagaggtgaaagatatttggttttttccctattatcaattaaagtttaagcaggttaataaaaaatacaattataaacctttagttgacactgatacactccctttgcagctgttagtgtcagtcaccagtcacttacctactaaacagtaagtacagtggaatatcatgtaccccaaagagatgaactcctaaaccaggaaccactgtactctaatgggaatagcctcagttcttgaatgtaaaatattcttaacaaaaacattcccctatcatgctttctgtatttgctaaatgctcacccactataacacagtccttctgcctgtctaccttatccaagcccctaccaaattcttctgtaggggaaatttgttgacaaactttcatgtgacagtattacatctctttatgagaaacatttcaataatcacaaaatgtatttaaaaattattctttcagttatattaacagtaactcaaagataaatcatttcttaggatattttaacagcaacagcagaaaacaaaaatgaaaaaacaaaaatctaccaagtgcctacccagtgcagtacttggtatgttcttgtcctttatctcatttaattaaaaagctgaaagatctgagacactttggcttatctttcagcttaaaacttaagactttttatcttgtatttttacattgatcatgtagcagaaccatatcaacatcaagaccatacaccttgtgacgacaaaattcagagcaaagtgacaaaagacaaaactcaaaacaaagtggcttagagtaccaaatattgcagcatataaacccacaaccttgaaaaaggacaccagagttctgcaagagaaaaaatcttgagtttgaaagagaaaaaatctctttcaaagctacaggttatataggtacccagaagtcaagtcatacatagcaatagctaacttacattttttttattagtgtgttaacgtttcacccacattgatttattaaattttcaacaataatcctacaaagaagatactattatgatctccattttataaaagaggaaactaagaaacagagaaagttaaattatttgcccaagatccctagtggcactgaaatttaagacacagcctgtctgacaccagacagcagaattctaattacctatctacctacctttcacttatcaacaaataagtgatcgatccctcaaacaccagccagacatacaaaccatggatgtccaacttctttctctcttctcacatacaaaggatatgaaaatcctaccaaaaaggaccatatcaattaataatctaagcttcctaacccatcttaatactactgacatttttatataaaacctgagtagaatttgattctagaaaaggttctttaaaatgttcatctttttaaactataagacctatactgaggcgagatgttttctttatagacatactagacaaataatcattttccccagccttccttatacttcaaattcttctgatttatttgtgtcttttttctgtttccaaagtccatgatctctgcccattatgtctaaaatcacccatcaccccatgtcccacaaatgaatacgaatctggctcatattcaactaataaagctggaaaggaccttagagagatcaggtcatctaatcacacttactcagaggcagacacacaactaggacaatgtgcacagtcacccctgaagttgggcctgccccaagccaccaagtcaattactagccaaggtaacaggggatacttgtaacggagagcactagcagtccatagcagtccatagcttagtgttctccattacaagtgtcccctgttccttttgtcttgctggcaggagggatgccaggtaggacaggtaggagacagtccaaacaaagcctgtcttttctactggataaatggaatttcaattctctctcaccttcctttgctcatagaaaggcctttgggttcatggtttacatgacatcacttttgttaattctcttctgttacgctacctacttttcaagtattgaaccaatagcaacaacaataaagccattactagtaccagaagactaataaggaaagtacggctgttgggttttatacacaaatagtacctgaaagtctttacaggctttctcagcaatgctatgcagagtacattacaaaaactactattgtaatcattggatttgtggctctaatatgtcatataccattttgaaaatttactacctactgtaaagttttccaattctaactcttcattccagaagacttttcaaggtatactttgaataaatacatcaaattgaacaagaattttattaaaaggaagacatactttataaatcatatataaatgggagggagcaagaggcagacaaaaggagaataaacaaaattacctaaagaggaagaccatctgtgtttcatgtagaaagagctttcaatgatgctttatgaacgccatttggtcttctcataaatcggcaaacattctaaaaaggtgcctttcaaaattttgaccactataagaaacacacacaccttctctgaaataaaattttcataagccattacttacccatactaattatagttttctgatttttttaatgctagtgatacgttaaatttatttcacagctcactagtgaatcacaacccatgatttgaaaacctctatactagaagaattgcaatgtgttagaatataaaatggcaaagttgcaaaatttgacaattttgattgaataatcacaacccaacagcatttcagggtgattggaaacaaaagtcaaacacacacaaaaaaggtccaagtaacatctgcattaagaataagcttcaagttaagaggaaaggtaagaagcaaagaaggaaaaataaatacttgagttattggaacaaacacattcaactctcatctccatttcataaattatgactataaagcctttaccaaatactggaacaaattttcccaatgtccagtattttatatgctactgtcctaatctgatcttctaccaaaatttcgagattagctatagagagtagggagatctgtggaccactggggatcagtgtcagcaccatgtcctgaccctgactggctttctacccagaacagtacaaacccggcacagcaaatctgctactatgccctcctagcctttgccagcatttaaactagagacatctgtgggcagcccaagggacagaaagaaaagtgttctaagattgccagttatttttagccagatagcttccttgaccattgcctagaaatacggtcaagccaatgtaaggagattattgggactgatcattactaataagtaactgaaaaaaggccaaaattagaaaaaatagtgaagtaaggagataacttcaaagtaatgtttattcttcaaaaacgttatcaaatacttttgaattagtaacaaccctgtcactagaagtgtaaggtttactacagaggttaaaatagataatctgaaaatcccttccactgctgaaaatctgtaattataagtttaaaccccaatatcaaaaaacaccttttaggggaattagatggtcagatgctctcttaggcatccacaaaggataatcctacccattagcaaaaacttgtagtgaatgaagatcacataccccaccccttccaaatcagtggctaaacaatgaagaaaaatattaaatattctctttcaaaatgctactgcctggttttacaggtatacacaaatgttaaaatttatcaaattatacattttacatatgtgtagtatattgttacatcattttgcctcaataaaactggttaaaaaaatactatcaccagccttctatcaacataaacatgttacttcattccaatgatcaaaacatcaacattatagccctaatattttctaagtttctcttttaaatttattttcccttgtattcaagttttattatattcttctcactttcctaagtcatcactcattggaaagcatagataccaagctttgatgagcaacaaaattttctgctgctattcaaatgacccattataatgctatggaaatatctttcctttaacaacttaaataacagcctaaaattctgcagattccttaatgacttcatttcttccttctcattagttaaggaaatgcatttctaggccagatctacctctgtgctaccattttatggctcagcattcattttcttccctcattctttattacaaagctatccaaaataaaatctgaaaataagggaaaggaagaaagccagtaagaactactcacatcagatttagaggatatattctcctccacatctgaatcattgggatccacaatatcatcaaatggcggtaacgttgatttcttcttctctgatgtctcactttcaattttgacctttcccatcttgacatgagatttatcttttatctgttttttgtcagcagaacaagtgagtatcagtggtggtgcgctagaaaaacttttaaataaagcctctgagctactctttttcctttttttggctgagagttcttcagaatctgaaatgggcggccttttactaggagccttcttatcttgtccactggtgatggtgagtaagttactatctggttttggctcttttgacatgggtttaggttccttgaaggccatcttaggaactattttctcttctttcagtggtttattttctttgggtttcttagaggattctttggaagatttgttgtgatccctggaaggttctttgaaggcacttttatgttctctggagtctttagaaggtttttccttgtgctccttcattaatttgtgaggctttgaaaaactggtactactgctgctgctgctgctgctactgctgctgctactgctgctgctgctgctgctgctgctgctgctactgctgctgctgctgctgctgctgctgctgctactgctgctgctgctgctgctgctggtatgaatactcctattagggtcctgcaaaaaggggagaagaaaatgaaactcccaaaactaaatagcaatgaagagtcaaaagagatctacataaaatgatccttctttgattcctctcaagctatcattaaaataccaaaaatattttaatataaaccaaaaaccacaatataacaggtgagaatagtgtatgtgagaaacaggtgagagtaggttattatcaaataatttaatgaggaaagctgttttcttaatcatctgaagcatggagttttaaaacatttcaattcaacaaatgttaactactgcttgtcctagaagatacaaggatgaataacacatggaccccacccttaataactatgacgtatctatgattgatagatgttgacaaccaaaagacgggaactattaattctgttgggagcatggggcgaagaataattcaaaaattcataaagaagtaacatctgaattaggtcctggaggataaacaggtagttactagaatgaaaagaatggaaaggtacttaagagaccaaggaccagaataaactaaaacaacagggagcaaagcacagattgtatttggggaacacccagctatagaacaagattgagaaggaggcagaaaaatagcccagcttcacatagtaaggtcagattacattaaatttcaaatggctttgcaatataaggaatcataaaacccccccaaaagaaataaagtaattctcaatttgagataaaaagcaattatttttatgctgtataaaatttcatcagttaagaactgtatctctcacccactaggaaaaataaaaggaagttaatagaacaaagatttcacctaaccatcaaatggactagaaagtctttagcaattactgtattttgatcatgagaaaagacgtaattgctgcctatttcattttaaatatgatcaatttttccactcatataaacatatcagaatatataacctatatataatctttctgtttaggaacaaaatctaagtccatacttaccatatttgtgaacctctaccattaatagtaagaataagaaacagagaagatcctggacatgcaaaaatccacatcaatactaaaagaagagctctttcttgcttacttccacttcctaatggaaccaaagacaaataaatgtccagattttcaactagaatttacatcttcaggcttgcttattatctttcaccctaactcacccatttaagccaatgatatgtaaaccaatcctatattccttaaatatctagcatgacacaggacagtaagcaagcaggggctatgcttttcactaaaatgaacaatctacttattgggtatatgcaaaaacaaaacaacaaaaaatatatatataggtacatgtataagcatcacaaagtaatatccaaatgaaaacttattgttctatattagtagaaatatattttttggtttcttaataaatttttttttgtctcatttgctcaacaacaaaatgacatataacaaaattattccatttattttctggagtggtttcaaaattctaaactgaatgaagttactaagcaaagacttgtttttatgcactaaattagataattccttagaaaacatcataatctgagatttaaaaggaaaattctaaagataggattcatattactaaaatttcattattttataaattctattacatttcctgtcatgttaagcaatactatgaataattaaaataaagtataatggacaaaccaaattaaggaacaacattttgaaatctaatatccttgagtttttttcaataggcttgttgacttactgatttttgaaaatttgcaatcagtattctaattatggctctagaatactcaagtatcactgtttaatattcaacctatatgaagtattatacacatattttgtaaataagttttaaaagcatacaatttttaacctaccaacatatttctaatgttaagtattaaaaaacagcaacactccagcaccaggaaggaaaataaaacttctgtatagatccttccatgatatatttttaaaatccttctttagaacaaactggaattctttaattcagggtacacattggtatctgacacagcttcttgtgtcataaaaaagttaagttccttttttaattacatgcatataatgctaggtacaaaactctagaaatatgtctttttataatgttttacttctcatgttggtctgggtattgaatgtctactgttacctttttatccactcaataaatcttggtacaagcaagtgacccagacattcttgttctttccttttttgtaattaccacctcaaaaatctttaagctaagagaacaaaagaggacaaacacattccataacaatgtcttaaataaaatttaaaaaataaaaggagagagagcagtttttaaggcagcattttctttgtcctgggcccatgaccaatgtcaaagttcaaatatattgtcaccagtctccatgtttgttcatgtaatacatgtaaaacagtggctcagatacacagccagacattaaattgtcactgacacagaataaaagctttcaccgattttcagcctatctatctgatacttatatacatatgggggtcttgtcaccagtctccatgtttgtacatgtaataaatgtaaaacagtagctcagatacacagccagacattaaattgtcactgacacagaataaaagctttcactgattttcagcctatctgatatttatatatatatattatatattatatatatatgggggtcttgtcaccagtctccatgtttgtacatgtaataaatgtaaaacagtggctcagatacacagccagacattaaactgtcactgacacagattaaaagctttcgctgattttcagcctatctgatatttacatatattatataaaaatatatatattatatataaatatgtatatctgatatatatatataatatacatgggggtcttgtcactggctttttaaatttttcaattaaccattaacctcaacgttaagtaccactgagcagcacagactaattagcattcaatgtaaagtttacacatgtataattcaaattctcttcgcctgaggctgattaggacaaactgaatatcaagcaatctaacacagagagcacgtgtgcataattcaaatctcaaatatttaaggcaaatgattgtttaaacataaatatacatatatttgcactaactttacaacctgtgactataggatacaatattttctctcatctattcagattgcactgaatgcttccttgttttaattttttggaacagaatgggtatctttaatgtttaatctcttctaatactacttgtcagcaactcaagtggaggacttaagaaaaaaatcagaactactggccagaataaggttttctgattatatgtggctttcagtttccatgttatctccaagtctacttttaagaaccactgacaactcatagctgattcttggcttccgtttcttcccgctggctatccctcttatttttggtctctgttctactttaactggcttctgtcttgtgaaagattttcagatcaatcatattttgttcaatgaaatttgcatatagacaaataaactctcccagaagagttttacttatcaaaaccaacaaactctcctagaagtttatttgttcaaactgcatttttacaaggacacttcctaaaaattgtagtgtggtccaagaggttatgcatatgtaggggtaggaaaaaccgtgacagtcaaaggtaaggttccaaaatacaagtctcctctaaaatgtcaataaacacacaatgaataacacagagggatgacaagccatctgaaactacaaatagctttgtgcagtggcaggatcatagccaatgaggtttatgcgaggcacaattactgctaactgaaactacgaatggagtattaaaattcagaattctggggtcaggggaggccttgaatttgatttacttttcccacttcaatcccaaatctaaccccatttacgtctcttgaactagttagctctgggggcagcaggcagtggcctgaagaatgtggccacgagctaacgggcgtcttgagaaaaataattggtgcaggatttgctctgcttgacccaaaagagtttatttgttttttttagagatggggtcttgctgtgttgcccaggctggaatgcagtggctattcacaggcatgatcactacatgctacagcctggaattcctgggctcaagtgatcctcctgccttggactcccaacaaactgggacgacaggtgcacgtgccaccatacccagcttccaggagagtttcacgcacacaggtatggccagccttcccagcactcagaaggcacttgatacaggaggagagtctgctcttagggctgcagaatgtaaggagatcagaaggaaggcacagaatcctctaggtgtataaacaagaaatagataatatgcttgctgctactgtgcaggttgagatgcctgtacctttcatcacttatagaattacaacagcctaaagtcccctaacagctcaacctcaatcccaatgcacatataagtgacatacttaagggtgggaggaaataggaggaagcagatctaacagattttctggaggagaaagatgaaatattgaggtcaaaagcagtatgactacttaaggagaatcaagtgaagtataaaaaataacttctggaaaaaaatgtttaattaaaaactaaaatttaaatatttatattctcaagctgaataattcagtagataaagtagaagatcgatgctaactggcagtataaaagatcaaatgaatgaaatttcaaagcacaaagtaaaaatacaaagcgatgaaagtcataatgggaaaagagaagagccttgaatggatcaaggaaacctaacatacagccataagaagagttccagaaggaagaaagagaaaagacagaagaggtaataattaaagtaatatggaaaaaaattttcataaactaaagagagggctgaattacaatctcacagagctcactatacttaaaaaaaaagggaaagaaaaaaaaaaacctgacaagtatccagaaagaataattacttaaaattgaataataattaaactcacattgtgcttctcatttgtaatactgaaatctagaagaaagaacagtaacatccagacagctgggagaaaaagaagtagaacccaaatatcccacacacacagtctgttgcgaaagaagtatttgccaaaatttaagaattcaaatagcacatcaaccactgtccccgccaaaggaaaggacttgagaaaagagtctagtcaaacaataactgaaccagaaacgttttatgtgtgggaagggaagaaatgaggggtaaaatgtatcttgcacaatatacagatttaaatctaaatgaaaaaaaaactgtaatataagtcctcaacatgaattcctgacacagaaaagtctaacaatctggacctaaacaactaaattatttccacagaaatttaggaatgaaagaggattagggtgtcaaggtgaaagaaagtgctggtatctttttttatgttaaagtggaataaaaattggattatgagcaattagaaaggaaggtggtcatttattaaatggaaaagtgcagaactgtcacataaagggaaaatggaaaatgaatatcaacttgaaaatataggcaaaattaagaaaagtgaaaaaagtcacaaatatgaataatgaacaaggtgaaaagacagtaataagatcaagtataacttagaataaaaatggaagaactgaattctccctctggaaaataaactgtcagactgggctaaaaagacaaagatcagataaaggctgttacaagaaatactttaaatcaattgattgaaaaaagtttaaaataatggaatgggcaaagaaatatcagctaaatgcccccaaaagaaagtatgagtgctagattaatatcagatcatgtggaattcaacgttgagagtaccaaataggataaaaaatgtaaaaatctaaattatataaagcaaaaggtatttaataagaagatttaaaaatacttagttaaatgagaaatcaatatatctttgtcataaattgacagacctcataaaacacaatgagtacagacacagtataattgaccaaaacaacccacacgctcatttaataattatacgtagaatttttctatctcgtttttttttatacttgaagttctagggtacatgtgcacaacgcgcaggtttgttacatatgtatacatgcgccatgttggtgtgctgcacccattaacttgtcatttacattaggtgtatctcctaatgctatccttgaataaagttcagaagttttatatgtatccatagaacactgataaaaatcaatcataaggtaacataagctttaaaacaccccttttaaaatgtttgtatagattacattggctaccctactccaagaaaattagaaaattaggccaggcacagtggctcacacctgtaatcccagcactttgggaggctgaggcaggtggatcacttgaggtcaggagttcaagaccagcttagccaacatggtgaaaccctgtctctactaaaaatacaaaaattagccgggccaggtggcgagggcctgtaatccaagctatttgggaggctgaggcaggaaaatcacttaaacctgggaggtggaggtttcagtgagccaagattgcgccactgcactccagcctgggcaatagagcaagactctgtctcaaataaataaataaaataaataaattaaagacaaataaatcaaaagaaaacaatgaaaatagcacttcatataaaaaaaactctggaggcacagaaaaacatgctccagggaaaattcatagcctttattgcgtttgttttttaaacaaaaaagaagaggtacaaggagaagagagaaaccaagtacaaagctaaacttagtattcactttgagaaactgggaaaagatccacaaaacatgcaaacattataatacccaacataatgaagaaagtaaaagaaacaagtttcaccaacatcagtgctttaattatataattgtataatgtcctgacatatatgtttagtgttccaatcctaaggagaaatttgccaagttaattctgacttaaagaaaatttacaatctacttctctacattaactgaaagaagtgaaatttcttgcatgtaaaatttcttgaattaaaaactcagattttccataaaaggaataagattaatgaggagacagcaatttagaaacatgtcaaaataggtacttaaataccaaaagaatcaacccatcaattggcagagaaagagagagagaatgtactaagggaaagagtgaagcaaaatggactgctgatgctttttataggatttttagcaagatatgagttcatattgtaaatgttttattaaaaattaatgttataataaaattataaaacagaaaacaccttaacaattggtaggattaatgtgttttaaagaatcaaaacctatttaaacaccgagtctaaacagagccactgagacccaaaatctaacatgtctcagtcaatgggcagaagactaaaagaacatgccacaagtggaagagaaatggcacttgagaagcccaagagtctttcgttcaaaacaatatatgtggccagtgcacaaaaaggacaaaaaatatttatacacactcaagaaaaagaaaggtctcctgttatgaaatacaatgctttggaaggttttacttgtttcgacttttgaataatctcccattttttaaggtgacattcaaccagaaagttagagggaactctacaatatatcctcgcagatccaaaataataaagccatttctagacctgaccagggaagagcagcagttttacaaaactaaagaattacatccttaaattcctcaatttacccagatctgtaaaataaccaatatagatataaccacacttacagaaatacaaataagtctggattttgcactaatgacgaaagatacagcaatcatcctaacagttaagcaagaaccaacacataacatgaaagagcaaaagatgatgctgaccgttcaaggagagattcgagagaataatgaaagattcccctcagccatacctgactatgaattctgacaattatttattaggaaagacaggccttaatagcagccgcaaagagtagtgacatctgggagtagtgacatctgggaaacaaaagaaacccacctgaaaactttaaagaggagatcaatattaactaatcactttaggaaggtcatctggtagcaatgtgggacagtgatggtgacaatgatggtgacagtggtggcagcggtaatagcttaatgaatgcttactaatccagactgatgtagaagttttatcattattaactcaacaatcttgtgaaatagctattattagccccaatttataagtgaggaaactgaggtacgaatatcaatgtgcccaaagacacatatataattagtgataaaactgacactcaagcccccagttagtctgacttcttttctttggagatggtcttgctctgttgctcaggctggagtgcagtgaccttctaggctcaagtgatcctccttcctcaccccttgcaagtagctgtgggactaagggcatgcaccaccactatatttttatagtcttaaccactacatttttatttacacttgtaaagtcagtgggtttcaaaatcagctgtcaatcttgccaatataacctgggccagaaatgaaagaagatatagaatgggggagaggctcaatgactgtaaaagaacatcatcaaaaatatgcctgttgtctaggcagaactatacaaatgaagttctatttatttccagtagagggggtaaaatattattttttggcaggtgattaaaaaatgcaatgggcccccctggccccccatatccaagggttctgtatccacagattcaaccaaccacggaccaagaatattcaggaaaaggccaggtacagtggctcatacctgtaatccctgcatttagggaggccaaggaaggaggatcacttgagcccaggggttcgagaccagcctgggcaacacagtgagaccctatctctacattaaaaaaaaaaaattagccaggcgtagtggcatgtgcctgtagtcccagctactcaggaggctaaggcgggtggatattgagctcaggagtttgagaccagcctgggcaatatagtgagacttcatctctactaaaataaaattaaaaaaaaaaaactagctgagtgtggtggtggtgcatgcctgtagttccacagctactcgcgaggggtgaggcaggaggatcacttgtgcctaggaagtcactgcactccagcctgagcaacagagcaagaccatctccaaagaaaagaaaatatttgggggaaaactcaaaataatgcacaattttaaaatacagtataacaactatttacatagcacttacattgtgttgagtagtataacaaatctagaaataatttaaggcatacaggaggatgtgcataaattatatgcaaatactatgccattttgtacaagggatttgaggattcatagattttggcaactgagaaggtcctggaacccatcaatcccctatgaatactgagaggcaactgtaatttattttaaaatcagaggctcttcttgtatacatttcaagtgggttaaactttgagtcttttggtactaaataaatatttttaagttgataaacttattagtagagttgtgttcagagggctcttgtgatactgagaaaaatcaccctctcctataatgccctggcagagcacatgatgcttccaattatttcaaagggtttcagaaaactgcaagatacttctcatctcacattaaatgttttcaaattttgaagtcataaaaatttatagtgctcaaatcacataaataatcacctccaaaaaggatgaggcgggagaggtcactgttttaagaaaactggagaatcttataagggcccctataggctgtcattaggaagagagagaatttgaaatattttacacaaaaacaggcagcaataaagaaaaccaaaagctacaaaaatatatggctgtgcaagaaagaaaatctaacattttagctgcaaataaacattctacctagtgataacaataaacaatattcactgattttcaacttttggaaactaatctactcagctccaccacttgctaagtgccttaaattttcttgtcagtaaaatgaggaccataatattaccacaatattacctataccacaaagtgagcctaatgattacaaaagcttaatatatgtaaagtacctatgtctgtatatgtgtgtgctttataaataacatgtatatgcaatgtggccgggcacaaagcaggaactatgtgagtgctttctattactaccaccaccactagtgcagacaagcacagaagacttaacattttattacatagcacaatgttatcaacccttacaacgtaagtgtctgaacagaagagaagggaaataactttaggataacctgaacttgagaatcaagggacattgtccatagttggtgagccaactaatatagttctacattaaacatctagaaagttataaaggtatccaagagatcaatttaaaatggtgtcatattaggtgtcattaaaatggtataatatggagcaaatgggttagattctcatgtaaaaatagcagcatagcatatagttaggaaactctggacattcaccttagaatttaaatatagaaacagttaaagtggttccttccagaaagtcggaaggaggttcaggaagattagaacataggacttctactttttgttaaacacttcgctatttttttcagccatgtaaatatcttcgacttcacaaatgtactttatcctcttccttttcatgcactcatttgcactttagagactttgtgaaatacattttgcattagaaaaataaaaagataaatgattcaacaatgtgactagtatcattctatgttttaaaaacacttcaattttccttctgatgtcatttgttatcttactgttttcgagcaaactacaatcaagcatcaatctacagacgtagcttcttactaagattgcactttgagttatatacatttagcttacatcattaataagatgaaaaaaatctacaaattatatttataattgagaaatagaaacacatgaaaaaatttatttcaactatgaagagaaaagaataagtagtaaattttcatttgcccagccttttgttctaaagaatttaaggtaaacccaataaatattttttaatattaaaaatatcctgaagtactgtatttgcacttaaatgaagcttaagtgtaaagtactgattggcaaaaatatttaatattttacaaaataatattttaaatagacaaaatatataatgcccttttttcctcaaatgactatgacttgtttcagctatgttgtacgtgctataaaatccttttgtttcagaatccaatttcatttaaaattctcctatttatatatactccctgacttgctatggcttaagttctaaatcatagttaagtactactgactgtaagttatatttagaagactgtagtttcaagtaaacttctgcctatctttgtggtttgaaactaaaaatttgaagtaatatttatatcacttctctttctaggtttttgtatatttagctttgtacagttcctgctttattaaaccagcttaaaaacacattggccagatcattccagccttctctcttagtactagcttgatttctgataattagccttgataaataatcgttaaataacagagaatagccaatcttcagattatattactaatcacaaataatggctggaagtataaaatgaaaaacagtacctgacacacacaaatttaataaatatactgcataaataaaagcccaaagagatgcaactgaacaatgggaaaatataatcaggtttatgctatcttgttaccttctctcagtagttattttatacatatttatgaggtctccagcatacgcaaaggaatatgctgaaactgttaaatactatggctttgcagaaaacaactcgtctaatttgggcaatatggtggactctttgggagttcttactatgatacaactagatattagataattacaacaaaacttcattgctgggccgttaaaaaaataaagaaaaagttcaagaatcaagagtatatgaaagagaaatagaaacataaaaggcaggccataaaatgtgaactacaatcactcatgaaagatggggttgccctaaggacacacgcatgactgtgttctcctgggtctctaaagaccaaacctgggccctatagcacatttggagacctaaacctcagagtctcaacagaaaccaagaagaagcctttacaaatctgctgttggggaaaaatactctgaattcaggtctcaggattcccaatgttcacctaaatcaaatacgaattcgcgatttaaaaatattcctgaacacaaagaaacaagccaccatgatgtgaggtaaaaggaccttaaagacttactatagggaaatcatcaaatgcagactataaataactatatatgaagtataaaaaggaaaaacactggaatccaaaaagcgaccaagcaataagaaattaataagaatgactgggccactgaaaagaaacaaatacgactttaagaaatgaaaaaaaaaaaacactgttggaatcaatatctcaatggactagttaaacagcggactgaacacagctgaaaagaattagtgaactggaagataaatatgaataaactgccataatacaaagacacaagaaaatgggaaatataaaagctattaagatacatggagaacagaataaaaataacaaatatcaaattagagacccagaaagaataaagaacatagggacacaatggtggaaattttccaaatatgatcaaagtcatgaatctacagataaaccaagtatagtataaaaataatatacataaattaaaaggaatttaatcctagacacattgtactaaaaatgaagaacaccaaaacaaaaaaactataaagacagtaagaaacaagagatcatgtattaaaaaaagagctagtggtacactggtgccagctaatagaggcttgactgggagccagctgttaaatttttaggaatttttttcagccagtttttaaacagtaaatgcactgtataaattaaacaagactattattttatataatataaaattgcaagcagagaaatattaaaagcagtggtaattaataatcaaaactcagcactttctaattagtttactacatattattatttgctgttttcttgaggtaattctctctgttgcataggatggcagaaataattcataactgtatgttctttccaactttgcaataactgatataatacggtgagagtatttccaccacacaaataagtaaacactaaaaatcatgactttttccctcagaaagatagttgctaaacatcagaaaaaccctaaatcagacttacaccagacttcacaaaaacaatagaaaaatattttcaaatattgaaaggaagtaagtaaaaacctagaattgtaaaaccagaaaaaacactttcaaaataggggcaataatcaaaactttatagattaacacaaactgagtgtttactaacaggagccttttagtaaaagaacatccacaggatttatatcaggaataaggaaaactagtttaagaagacattatggtaatataattatgctaaaatttaaaaacgttttaatgtttttaaaaaaactgtatatatttggaattataaaaatatacttcaataattttcaggttaaagaagaaattaaaataaaaattttcaacttcatcacattgaatgataaagaaaatgctacattaattttgtggaattaaaataggacttgaaaaaattttagccaccaatcctcgtctgtgaagaaaatgatggatgataaatgcacagaagaataataaactcaagcaaaagaaagactacaaagatttttgtaaccctaataaaacagtcaacaaagcctaaggaaagaactttgaaaagaactaataaaattcacagtcctcactgaaagactgaattaaaacaaaggagagaaagcgtaaatacagcataggaagaaaaaaataagaaaacatctacaagtatagcacagataaaacagataagaatatatcataaataattttattgcaacaaatgtgaaagcaaaccttgggaaaaatgtaacttaccaaagctgactcccccaaaaaaataaaaattaggaagaatcctgtattaatatcagataagtagtttgaaatcttcctacaaagaaaacatcaagcccacagggttttagaagcaagttctaggaaaagataattttaacgttaaagaaactcttctaaagaatagaaaagacaggcaggtatggtagttcatgcctgtaatccctgtggttttaggaggccaaagtgggaagagtgctctcttgaggccagaagttcaagaccagcctgggcaatatagcaagaccccactgctaaaaaagatttaaaaattagccaggcatggtggcacacacctatagtcctagctaatcagcaggctgaggcaggagaatcccttgagcccaggagttggaggctgaagtgagccatgactgcaccactgcactccagcctgggcaacagggtgacaccctgtctcttaaaaaactaataataatagagaaaaggaaacatattttatttcctgtggttaatattatcaaagcaacaaatcctaccaagaagagtaagaaaaagaagcatatggcctaatctaactcaagaatataaatgcaaaaatttttgaatagaatattagcataactaatccaattgtaggggggaaaaaaaggaaaaaaatctaatagaccaaaaccacattgggtttaatcccaaaattcaagagtactttggcgtgacaaaaatgcttgtcaagcactacattaacagattaaaggagaacaaaaccatctgttcatctcaatagatactgaaacgttttctgataaaatcaaaaattcatccatggtttttcaaaaaatgaaaacaaacaaaattccttacaaacatgactaggagataaattccttaacttgaaaaagagtagctaccaaagtcccatggagacaaccttctaaatagcaaattattagaatcagtccctttgtaatcagtttttactggtattcctactaactcaggactgcaaaatgcactggggggaaaaggataggaaaattggaaataagacaggtatgtgtcattattcacatttaattgtccacacagaaatacaaaaggatctgtaaagaattaataagtttagtaagatgttagaagtcatatcaatatcctaaggtagactgcatatttacacatcaggaacaaacaggaaacatttaatattaataatagcaaaacaaaatataaagtagctaggaataaataaagcataaaactacacagatactttaaagacattaaataacatttaaataaactcattgagaaactaggttcatagatgagaatattcttcaaccacagattcaatgtaatttcaattcaaatctcaacagtttttcagagaacttacactgagtctaaaatgtatatgaagaaaaaaatgatctactagaacttgttacattatatagccaacctctttatgaaatgatagtaattacaacattgtagtattgctacagagatcaacaaactgatcaatggaacagaaatgtacacccttccaaacagactcataaatattttaaaagctgatgcttgacatggcggatcattgataaaagcatagacaacgcaataaaacatgctggagctggtttcctatataggaaaacatttaaattagactcttacctcatacatacataaaatcaattccagatatttgaaaatatttcaatgttagacaaaacttctaaaacttttcagaaaattcaggagaatatctatatgaccttggtataggagaatatactaaatgggacattaaaaagaactaactattttaaaaatctgatcacattaagaatttgtttatcaaaagataccataaagtaaaaaagccactaactgagaaaactaggaaaatatgtcaatagtaaatagaaacaacaatgaactcctatctccaggatattaaaagacctctaataagtaaatagaaaaataagtggaagacatgaacaaacatttcacagaataagaaacatgaatggccaatgaaatatatgttcagcttcattaatgaacatataatcactgcaatgcaaaataagagaataatgatacaactttatgtgcttactaaatgtgcatagatgaacaagtctgacaagaaaatagaacaatgagatctcttttacatgctgacatgagactctaaattgctataactattatataaaataaaccaaggctaaataggtgactgctctatgacccagcaattttattcataggtatacaatataagacagcatttctctgaatgtagtcggcagaccagcaatattagtattacctagatgcttattagaaatttatatttttaggccccaccctagacctactaaataagaatctctgcagctgggcccaggagtcctcatgtttcttaattctccaggtaattctcatgtaccctagagtttgggaaccactgagttacagcagtattattcaaacagaactggtttaggtaaggctggaaagcaatatagtagactccataattgtttataagtcaaccagtacaaaattaaatagactgaattccatgtagtaaaggttaagcatggtttatgaaacttttgtctcatttgtccatgcatatttatttatgtatatgggtacttgatcattatggaaaaccggtttcttactatgggtcacggtcataaaagtctgaaatctaatgccctacagaaactcttgcatgggtatactagacatatgcacaaaaaggttcataattgcaaaaccaaataaaaaggggtaatctagatatctagataacaagacaatgaatacacaactcatgatataatcactctttggactatgcacagcagtgaaatagacaataataaagacaaatcttataatgctgaataaataaagcaagtcaaagtcataaaaaatacatatactattataccattttcataacaataaaaaataagcaaagatgagcaaacaaacatacatttatggtaaaaccatgtttaaaagctcaagaaactttaggaaggtaattatatcgagagaaggcaaaggaatcgagtgagaggcatatacagatagttagagtggtttgtaatataacatttttattataagaaaaattcaaaattcctgatgtcaaaatcttctagtctaggaagagaaattcacattcaaattcagcagatacttatttattagctgctatgagcaaaacacaaacacagtgtctcatttaatcttcttaaagagtcctgtgcggtaagtacttgataaagaataggcaatcaagtatgtgctcagtgaataaatgcttgaataattttataatattaaaagagacagagtttgattatatagtattatagttctactgacaggagttaaatgaaataacataactttaaagagttactaatatattcttacctttttttaccttatattacttattaccaaaagtataatgagaaaaatattcaagtcaaatcacttttttctatggaagtattatattgctggtcaaaggtgtacaaactaacaaaccgtagggcagaattagctgatacgtaacttcagcaatacccctttgtcctaatacgtggagttagctctatgtgcggcacatacagggtggggggaaaaagcagagctgtcctaatatagaaaaagaagtcaccaaggctggaaaaaaaatcgctttttttttcagtctatgcactttaataagaacaacagtttaaaagtgcaaaatcaaaatctttttgttcattgaatacatatcggcgtaaacaaacacacttgggaaacggctgccttacaaaattatttccatccttcacaaaaaactatttcccttcacagagctcctacatatgtatgcttttgtttttaaattttgattcactgttgtatctctccagcacctggactaatggctgaccctaaaaggcacataataagtatgtgcctttgaatgaatgtatacatttattgagtatttactatacagtaggcacctggggataccacatcaaatatattatagtccccatccacttggagctaacgcaagtgatgaaattatgcctttttgcccccttaacaattcagtccaaaagctcttatgtcgggccaagcaaagtaggcaacggtgaggaggaacggctacaggtggagagacacccgtacaggggctgggagccaccaaaagggcctgctcttcggagaaatgctgaattcagagcagggacaagaagtacaaaatgaacttgacatatctttttatagaaaaaggttaaaaagtatgcaaagaaaccaggttaaaggggctcccactggccaagtcaggaaaattaaattatcaaaataaataatgatagtaataggttataacccattgaaaaaatatatacccatgagtccatgatgataaaataaacataagaataaacttaagtctgaggaaaaatgggatatttacatcttctcaaagtaccttccaataaaacacttattaattacagagagaaactgtacagtggagaagcctggaggatgccattcgaatcaagtaatgggtgttaacatcaacagtaatgtctcagtggaaatcaggatcatgtgatgtggttcaatgagaagagtgcagatattcctaccaaagatgcataacatgaatctagttgcagggaaatatacataaccaagtatgtatatctactaaataactggcctgaagtctttaaaatcttcaagttcatgaaagtcaaggaaagaccaaggaactctttccagttgatggaggctaagacatgacaactaaatgctacgtatgattgtagactggatccttttgctatcaaaataaaggacagggccaggcatggtggctcacacctgtaatcccagcactttggaaggccgaggtgagcagatcatgaggtcaagagatcgagaccatactggccaacatgatgaaaccctgtctctactaaaaatacaaaaaaaaaaaaattagctgggtatggtggcacgcacctgtagtcccagctactcaggaggatgaggcagcagaatcgcttgaatctgggaagcggaggttgcagtgagccaagacggtgccactgcactccagcctggtgacagagtgagacttcatctcaaaaaaataaaaaataaaaaaataaaggacattactggaacaatctgcaacaaaactggagtaggatctgaggataacaagttaataatgtatcagtgctaattcctgacttggatggttgtactgtagttatataagagaatgcccttgtttgcaagaaataaattctaaagtattcagggacaacggagcatcaatattggcaacttactctcaaagaaagaaaagttttttgtaccatacttgtattacaagtgtaaatgtgagattatttccaattttttttaaattataaagtaagtaaatagtatttggggaagccccacatctcaatctatgcacagtggactaagggactctgggaagggcactgaaatcagaggatgtcttcaaggggccttcagtctgtttcaatttgctccacttggctgtctcttcaaggacccataacatactgtgcagacctaaattgcaccatattatcctaagaggaatcgaaatgccatcctgaaaggaacaaaggcttccttatacaaattagttgatctgttagctaaatcaagccttttctaataaaaggaaaggcagtggttttctctcaaaaatgccaaatgaggttgttcttctatctatatcacacacaaaaacagagcaaacaaaaaacaagcataatctgaagccttcagttcatctcctctcaactaaaatatattgtctcggttgcagaaaaaagacaataaacttgtaatataaattcaaaggtgtatttgggaaaaacatttccacatcttgttgggaaaatcagcttcacttaggatttgttgtagaaacaagacaattttacacacatgcactttgatcatctgatgatttacacaaaagatcagcattcttaaaaaaaaatgttgtttttgccatccttagtctttagagactcagagcctgcctggagtgggatggggaatggagtccaataaaaaagcttctggcaccccactaaaagaagcagatgtctgagtaccacagctttttctcctgaaagcacatgagggcggcctggactggtggctgtgaatttgttttgttttccttctttctttcttttttagagacagggtctcagtatgttacccaggctagactcgaactcctgggctccagcaatcctcctgcctcagcctccttagtagctgggactacaggtgctcaccaccacacccagtgttttttaaaaaaaagaagaaactgaggtagattattccaatcctattaaaagatgagaatttattatcccttaaaagttgaccaagggttaaggcttgatagaaagcaaaacaactcagtgatctttcactatatacccaaaatctggcattaagtgtggcccacagtaggtactcaaatacttcaaaatgaaaagtatttatatgtcctccagataaggcaagcactaagctaaaaaatgcctcttggaaggacatttttatttttgtttatttatacactccgagctatgtaggcagaaagtgggaggtgtaaggatggtatctgaaggaaaaaggagtacgggaagacttaggaaggtcctctcgaacttgattttcagaagcaaaagaaattagttttgtatagggaacttcaatctatgaagcagaaacaaaagaataaaaatcttctgccagaagtcttccaggacttgaaaagcatcttggatttcctgagcctgtcttatcggtcctagattcaaatattctcaaccatttttagatcataaatgctaaggactgtacacgcatggcggggtagtggaatatgactataaagaggccaaagtagctcccccagagaaaaggtagcaaagtcagccacggtaaactaattctattaaagggtactaccatcctactttcctaccctgagcggaaaatcttttaatatctaagcactcaaagaatcacaataccccatggcttacttgtatctctactttcaaaaccctggtagattacagttatttcttgactttatgataggctttttcatatgctgattaatgttgcattaaccatttttagaccacatataaagtcatgcataaccttgctgttcaactgagtaaaagaaaaactccaaaaattatgattgcctcttaacttacagaaaatgcaaacttaaccaatccccacagataggttgatgctggctttaaaaagtttaggggaaagggatttctaattatcatattctccacataaattgtattttcagaagcaagagaaatacaggaaactttagtctacaaagcaataaacaaaaatatgaagtccgttgctgccaaccagtgaactgcttcactggcagtttacccaagttgtcttcagaaaggagactcatgcaagattgctccattggtcctaatgcaactaagagaagtggccctggggatttttattttttaattctttgtcttcttttcattgcatttccaaaaagaaagctaatatcactatgtgtaaccgtagaaagaatatgcaagaacaatgaacaaaaaccctgactcagctatctcttgcttgactgatttcagtatttgatgccttagtttactcatctgtaaaatggtgaccttgacctattatatcaaagaatttcatcagctacaaaactgtatgatttactcattttatagccataaaaatacaccctgatccacatgcccagaatctaaatgtattaaaaataatgaaagtgttcatgggtttttcctaaacagcagtcactgtgctaatcatttctcatgcattatctcaagtcatcctcacaactactatatcctggtagatggtaccaacacctcattttacaaatgagcaaacagactgatagagattagtaatgtgcccaaagacacacagctactaagcaccaataccagcatttgaaaaaaagggctgtgctatgagtctgcctttctaactgttatgctgtatccattgcattaaaaaaaaatcaagatcagtatgcagaaaattgagcagtgagaaagttactacacatctcaatttctataggtgtcactattatctttaaggctgatcaatccaaagtagtttaacctaagacctgtgagacattcacattctatgttgctctgcagtacagaggcacatacatctgatgtcaagctattttcattttaaaaaggtaaatcagaataaaggtttaattacagctttttttaattaaaaaagaaaaataaactgaagccaaaattaagtgtacgtatataagccacaaaaatatcttccagaaaaaaataaaaaagaagagatttcagataaaatgatcccaggggttggtgtgtatagagaagtaaagaagctcaagaaacctgaccctgggagagggtgtagtggacgaaagaagccaatcccttctctcaagagtaggaacagaaatctaggaagaaaaaatacaaaggggacgtaagagaaatgactcaactagaagtagttctagccctggccctgagacccatatgaagagccaaatcagataaagtacatcttaaaactggaacatagtagaaggtatttttattaatgctgatctagaatattcctgatttagagctcactgatgatctctttgccaaagtattcagagctcaaaatcatcagaaaggaaaattccacttcacttaatctttactttaaaaaaacaataaataactatcttttgtgtgaaattccctacagcaagggctacattattcagctggtcctctagtttttgtagccatgttctttcaaaggattagcttggtctcatagtcactggcatttgaaacccctggtttagcaaaacagtcttatcaaaagtttttgctccctatgcttaaaccagacctttatagatatctatgaatgctggacaatagtgttataagctaaaagcacaaagcagagtggcagaatgagaggtcaagctaaacctttgaaagaacatgactattcaaaaccagaacactctgataacaaattttcaagaaagatgtatttattatttctccagataactctgtctagactatatcaaacaagatagctttaacatcaaaatcaccttttttatgaacctataaatagtgccactgcaaatggttgtccagatggtaccctgcataggaagtgtggccaatgggatgaggattagctgaaattcagctacactatgctagccatgccatgctccttgggctggggtgttatagagtggggagaggtagcagcactttacttatttatttagagacagggtcttgctctgtcaccaaggctggggctgtagtgcagtaacagaaattataactcactggagcctcaaattcctgggctcaagcgatcctcctacttcagcctcctgagcagctaggactatagaggtttgtcactacaccaagctaattttattttattttactttattttattttttgtagagacaggtctcactctgtggcccaggttggtctcaaactcctggcctcaagtgatcctcctgccccagtctcccaaaatgctgggattataagcatgacatttatttttaatttgcccaaagacacaatggtcaccatacgcatggacttctgtctatattacccatataaattcctatcttaagtcaccacaagttcatgtaaaggctgatatttgtaaggccaactaaatttttattttacttcattttactctaactgtagttgattggaccagtttgtttcatgaatagggatccttatctcactcaatctgtccattattttaccatttcacactacccacaggcccacaatgtaccctatagtgaaagggaaggtgtgaatcatatttgcaaagacaagctgcaaaatctacacctgcaataatctatattaaattacaaatcttaggccaggtgcggtggctcacatctgtaatcccagcactttcggagctgaggtgggcagatcatttgaggtcaggagttcaagaccaacctgaccaacacggtgaaaccccgactctaccaaaaaaatacaaaaatcagctggacgtggtggcgtacatctgtagtcccagctactcaggagactgaggcaggagaatcccttgaacccaggaggcagaggctgcagttatccgcgatggcaccactatattccagcttgggtgacagagcaagactccatctcaaaaacaaaaacaaaaacagaaacaaaatatttacagatctttccaaataactgatctatggactaaacagtcatcaggaaaaaaaaaaaaaaaagctagtacatcatacttctgtattgtcaaaaccatgaagagaaaatttcaaatttgtgcaaaacagttcttttgttctcaatgttaaaatttctgggtcttaagccagtaagtttaattttgagaagcagagcaccaggaaggggagtggggggatggcggagaaagaaagcaatagaacacattaatggtaagttctcaacaaccagaaagtttatatcaatcctctgaagtgtgaggacatagaataaagtcatatatgtttaaaatctatgcgttatgtttaatatattaaatgcaaaatatagattttcagtgggatctcatctacataaaaatataatgtgaaatactgacagaggttatagtcaccagaaagattacaatgacttattttcttcttttttgcttttctagatgtccacactttctaaaattaacacatacttatttcaaaatcagggaaaatgttagattccttcttgaaactaaaatatgttctttctggtagaacattattattatgtcaaatccttgtaatggaaaccttttactttcaccattccagataacagaaaattatggtttaaccaaaaatataataaatctgcagaaaaaaagtcatgtcaataaataaactaattatctgctgactacttaactatgtaccagatagcatttaataatctcaaatgggagaaaggagatattatgcttattttagatttatacaaacctaagcccaaggtaaattagcagcagatcctacaattgaatttgtgccttcagatatcaaatcaaacattctttctgttataccatggctatatcccctgtggtaatgaaggtttttatattaagccacctaccatctatcctcaacccctgaaaatgaaccacatatgcctacttcgagtctcagacatttgtttcttaaagtgttaccttcagatcctgattattgtcaggttttcttacaactcatggaacaagaaaacaggcagaaaacaaaatgttaatcatagcccccgttctcctcctcaatttcccctaaaattgttttcacttaatattatagagtatgaaactcaaaaatatctggtggggacagtcaaaataggcatctgcactcacagacaactcccttaccatcctagaagagaatgaactcagacaaagtattagatacactttgtatgcatccttgaaacaagtacataaagagctagtacctaagcaaagacgaaatagagaaacagaatcaacagttttcaactgcaatatttttgtatttaaacagagaaacaattatttcttaatctgaaacttctcccaacattcacatcctttcatatttttccttttctgttcatttcttattttcttggctttttgtgcaattggggacaggaggtagtagcaggattaagtgacaactttaagatatcacagcatttcctttcaaaactaaattacggttactatattaagagtttcgtacatacagtcagctaaactgctacttcggggaggtctgcagaaagaaatggggcacaccttccaatactgacaactaaacactcaaaacaacttttcttagtacacattctaggaacatctccctctctcctctgtttttctttcagtctttgcttagtttatgcagtaatggcgtttgagctttcagcagagtggaaagtttgctcctgtttttttccttgtcacttaaaaggtaaacaggtagttgggaaggaaggaacaaatgaagacacgaaagttgttttatcacacagatttttctggtacctattttcaaaagtctgtaactgccctgcaatcaacgtgtgtgactttaagaagacattaaatcataaaaccactaaataggttgagtgacataaataactttgtactgtcatgaccatgctttccctgaaataatttatgagatcgacattacatttggaattaaggctcacaattttgactttctacttaacatttatatgtatgttccactttcataacttaattttccagagtttgtggggggaggtggccgacaaggttatagaaagaaggagaaaatgccaaatatgacagaaaattagcttctaagaaataaccacacaaatgaagcagcctgcttcgtcttacatttatttaaataaaccaccttttatcagtgccagtaaaaaagcagcagcattcttttatcgtttgaagtgacaattacagaattatatatatcagaaaataatcaaaaaggtacttattccaaaacaaatatccaaaaatccaatgaagctgcccagtgacagccactaaaataatcttctctgtattattttctttgagtcatttttaaaataagcagccagctatccatctctaggcactgtctagatgagtttgccacaaaagccacttatatttttagaagccaaagtcttgacaaatcagttcctaagaacataatttgttacacatcgaagaaagcctgaaaacacagaccttggttaaagaggcttccgtatctttttgtaacctttccaaatgtaagtatgtgggaagagtacccataaatttaagttgaaactgaaacacttagaatatttccaatttaaaatacattaaaatgtggtctttgaaaggaaatgaaaatggctttttaagcatatgaaaagttgctcaccatcactcatgagagaaatgtgaattacaaatgagatgccatttttcatccatcagattgggggagagggtagtttaataaatcatcctgtggagaaaaaggcactcacgtactatttggtgcaggcatagagtagtataacctctttggcaggaaatgtgtagatgtctaccaaaatttaaatttcactttgccttggacccacaattctactctaaggaatttatcctacggacatatccatgtgcacaaagaactatgtatgagtttatttactacagtattactggtgtcctagaggaaaacctaactgtatgtcatgatgcactgtgtgtatatttacctattcaaaaaaattaaaatttgaagagaagagattgtgatccatacagttgagaaattagaagtgttctcaactcccctacaaaggaaacactaaaccaccctacacaagattcattccaaatccttgtaataaaatgctgtgttcagatggcttgacacagctgcattactgaaagctccttatcctaagatccttttggccctttaataagcaaaacccctcgctggaggtccactgtggacctgaatttcacttgacaataagcagcatttcagaaagattccaatttattccttgtgaaaacagatcatatataaatgtaactgtcactctcagaaacaggactgcattatgctgcagatttaatacagactggaagcatgttccccatgtcttctccagcaaatcttgccaaatgggcgtctgaaatgtcctactgaaacaggtggtgtctgaacagaattggatttctgcctatagaaaccctagttttaacaactgctgtggttagttttaattttcagtcctcaaaattaactgcttgccagtgattcagaaataggactgaacaacatgtttagactttgccctgtttaattgaggaaaggaaggaaggaaggagggagggagagaaggaaagagggagggaaggaagaaagaaaggcagcaggaacaaacaaacacccaacaccctaccaccatcccataaaaaacaacagaaccaaagcaggccatttggtttccaggccaaaaaaagaaaaaagaaactgcaaaataaacttgattttccaaagatgcttgcctattttgtgctttcttcgtagaagcacaaggatccaactaccttgctggtcatatatgtgaactcttctaaggaaacacacagccttgagaagcctttaatccgctaaaaattcagaattaagaacaatgttaagaatccatttttctaatgaaaagttacatcttacaaaataatattccgagccctttacacaagcaaaatacaaacaagcacttcatacaagcaaaatacaaacagagtgccaacaccttgaaggaagaaaccacgggctaatctttaaacacaacacagatctatcaatgcgctggttacactaacttggtggtaaacatgttttcctgtgaataaatattgagtagcttacactgaatagcaaatctttttcaccatacctttaagtgtctgatataaagatggttaagcatctgctgatattctaaactagtaactgaggggaaaagaactaaggtactgggtatctactatgtgccatacaccatggttacacgttccctatgaggaaaacactgccatatccgtttcacagctaataaactgagatgcaaaaagatgcaatggtttttcccagggttacccagcttgaagatgataaaggttttatctaaaccagcttgaatttaaaacttttccaattgtatcacacttctttccaaccagaaattcagaaaaacaagttagtagaataataaattttagttccccaatatacaatatctaatatacagtatatgtttactttgccaacaccccaaagaaaagctcatcttctttcatctatcttatagtaatagatgacaaactcttctgcaatgttttcagtatgactgaattccaactactaaaaagtgataagggaatagagagaaaattatctgtcgtgatcataagccttttaatcttaacatcctaatgagcacaatttgagaatcactgatccaaaagtgatcaatcagttcattctttaaaaatgggaaataaatagaaatatctcagcaaatagggaggtgcttctccacagagtacacttggtccttttgcttaaaattaaaagacatattatgtttgttcttgccctcaaaagtttactgctcactgctctcttccctctaccaatcaaagaataaagatctcaaaggaaatatcctcccttaatataataacatacaaaaatttatataataaatatgaataataatttttaaagtaagttctcaagttgttctttctcatttcataacccctaccctctttctcttacttaaagccttacaaggggctggacgcagtgactcacacctgtagttagagcactttaggaggccgaggggggctgatcatttcagctcaggagttcaagatcagccttggcaacatgggaaaacctgtctctacaaaaaatacaaaaattagtcaggtgtggtagtctgtgcctgtagtcccagctactcaggaggctgaggtgggaggatcacttgagcccaggaggttgaggctgcagtgagccatgactgcaccactgcactccagcctgggtgacagagtaagaccctatctcaaaaaataaaaataaaaatctaccagcctaggcaacacagtaagaccctgtctctacatttttttttttaattagtaaatgtggtggcgtgcatctgtagtcacagctatttgggaagctcaagtgggacgttcatttcagcctggcaagtcaaggctgcagtgtacaaaaatcaagccactgcactccagcctgggcaacagagtgagactccatctcaattaaaaaaaaaaagttcgtcgggctagatcttaaatcaaatccacaatttccccagcaagctcccatgagctgtctaatttagaggaaactactttcacggtcctataaagtaaatcactctgtattcaatactctcagaaaataatgtttgaatctaaatgtgccctgcccacaatacttcttcttttataacaagaatatacttaatattagggagccatgtcacagaaaaacacagggtatatttcttccaagagggacatacaccaagttttgagactatttaggaaatagtatgacattgaaattaaaaacaaaatccagtgaaaaaaacagaatgttattgacccctctcccaaaaaagttgttataggcttatagattatgaagtagaaaaaatctgcagtttttcaagattctctggcaaaaagttctttggaattattttcttctaagagctgaaaaacattttttccaagatgctcccagctctaaaaacaacctttctgatctcttgaaaagcaacactcaacttttagtagctctatgtacttttagtttaaaagaaaataataaaagagaaggaaccatagccaaacactaagtttactccacccatgccttaacttatatattaagatgagaagagaggttcaattattttttccttttaaggtagaatatatacatctatgtcaacacataatttttaagtatgaggaggaaagtatcctctctcccaccacaaaacccaggccaaaaaataagaagaagaagaagtttatctgaagacataatcgtgaactcatttctcattaaatcagaatggctcataagttagtaacaccatgataggctgcattaatactaagataagacaaatggttaaagccaggtatcaataatataaggcagtcaaaaatctaggtaagccaaaagatgtttattagtctactgattttttttacatttctatagaagtttattttaatcttcccatatgaaatagacagaatctgtggaattattatgatttttaatgaatttttaaatgcttattttactacaaaattcactgtgattagtcccttaagtaacttgtaatatttcaaacagcatatgcctggaatagttcacatttcaacttattattttagagttgtcaagacacaatctaattctaataggaaaatatctgctggcttcaaacagcacttaaacacaaagaaggaaagttagaagtcaagaagaatcattctgagataaaggctgagtagagcacaagatgagaaatcaactagagaccttatcaggatgcagtgctgcactttgctgcattatcactgactgtaacctctcttccagctcacaggcaaccctcgacttctctgggactaagtggttgctttaaaaagttcttgtgtcatatttacgttttcctacgacccttatcagaagcatgacgtactaaagttacataatttgcactctccaatttacccacccaactacacaacccaagagagataatcagaaatgtaaaatgccgaattcattaaaaaaatgagattgattaggattttaaatggaccagttagttgattgttaatggcatagccataggtaaatggcatcaaaactatactcctgataactataaaaggagtaaaacagagttacttttccaaacaacttctttaataaaattataataagttcctaattttaaaataagttgtgttacaaaaataaatacatttcttcatgaagctgtatttctcccatagaatactctaagtggcatttcatttccaaagctggctcaatacccacttaaaccataatctattgacatatatatgataaggaatgaaatatggtaaaagtacttgcaatgcttcaaatgcatattcataattcaagtaaaaggacagcagcctagcaaaacagaactcaaaaaatggggtccacatcacccagaatagtcacacaattatatacatgggcaactttctcataataggaacaatagcttttcttaggttctcaaagtggttgttcatgtatccaataaagaaaactgtgccacaaaaaaaccacctgcttcctacaaagccctcaggtagagtttatcagtgatataaggcatcttgatgggttatggtctacaaatgcatatagaaaataacttcataaatagaaaactgcacaaaaaccttccagagaaactaagtgaagatgatcctggagaaaagaacacatctcaaaatagatggggtgtgaagtgcccacataatatgacacataagttcatgtgcagtaggagctgatgatcccagtgacactcattgtcaaatagattttgaccaatcaatagtgtttgtacagctgacccagcttcagaagcaaacacaccaaatgtttatgtttccaagaggtaccacttaaaattctttcccatactagtcaaatcacaagggcaaaagtttacaacacttttgctaccattactttaaaaaggaaaatccatcttttatcaacataaaattcaaacaaacaaaaatgtctatttaaatgacccaaacatgtagtatgagtgaagataccttttttaataattgtgatcaagaaaatttggatttctttttatataatttttaatgtgacttgcaacttaacccaaaagtttctataactgatataacacagttcaaatattattcttttcttaaatgagagtttattgcttgtttgttttggggttttgtcataattaaatttgagctgcatagatcttaaggctgttttaataaatagtgtaatttcaaacttaagcctatctaaaatattattgtctacctgttcatctcaacacatgaatccacagctaagccattaaggtacatcatttcttttacctctcccaaaaccttatactttttaacacatgaggaactagtttgtttgtttttttttttgttgttgttgttttttaataggaatgcttttcacaagagagtgccacttacccctcctgccttcagcaactttctcctaaagtcctctgtggggttgttgaaagttagcttttcacagcggaggtgattcactggtggatggccttcaagatgcaggaataagtcataatcaaagcggactttcctaggttcttcctggaggttaacaaaaattatgaaagaaaaaagagagtgaggcataagtgaaattttaaaagcaaaaatttactcctcataagaaatagaaaagaactaagacatctaacagctaaactgtcaaagtagtactgggaaaaaaaaaagtatcatggaatcatcagtgaaacaaaatagaaatgtctgacaaattagtttcttgtgttaggggaaatgaaataagaaaaacttctcttcttccccatgatctttcaggtgacaggataccagcaacatagccacccaactagaaaccaagcacattccttcctcttccccaccccagtacactcaccatcaaaggctgccattttctccataaatatttcttcaacaagccctctaactcttactactaggcttttactcatggcccaaactataaactctctactttgggatatattctcttcaattcctcctccattcaggccttaagattatctatatgaaataaaaatctagccattttcacttcctagttaaaatttcaacagcttccaatagccattgggctaaaaatcctaatctcacttgaatgtcacataagggccttcataatctggctcttggcttcatattccaccattccccttctgtccatctgatggcctagcaacatcccattactggttgcttcccagtacctactgtgttctaggttacctctggtttcattcttgctttgcattactaccttcactgcctacctccatttctctacctactgctttacctagataacttctcaccattcctaactcaagatttcacttttggaaaacctccccttaactcccgactccccactgcctctcctctactatgtatgcatctttctctcacccttgccacgtcttagaataattgccttcttattatcaccatttaccctgctggatcagaagactgttgaaagtaggatcaatgtttgaatcatcattgtgccctcaaagactagtttatgcctatacacagtagaaatgcagtgagtatctgtgagattaataagaatggaatttttctgaataaataactaggacaaaatagcatcctatgcaaaagaatacaataattagaatttccgatacccaggttcaactctcaagctgttacttaagttgactgaacatttatccctctctacacattgatctttagccacgcaaggtgaaaatacagactcaagataataatgacatctcatttaattctcgctgctctctttggggcaggtgtgagccttgttttattgttatattactaataaatgatgaaacaaaataatttgaatccatttcttttgactcaagggtctttgcacctgaaactctccgaatataggaattaactactcaaaattcatggtttccacctcctcaccaaacttcccaaatcataatctccactcatttcctcagtaccccttcacttccactacaatctgacatgaaatctacttttcctctctcttatcaggatgccattctctcctggttttcctcatagtttactggctattccttctcaatcttcttcaaggactttcttctctttcttcactgaccttaaatgtcctttacctttctgcaaagtttcccaaggagatgacacccattcacaaggagtcagttccacctgtgtgacagtgactcccccaagtgtatctccaacccagctctcactgactgccatatacatgtgtccacaggttgacttacggcagcatccaattcatgcattatgttaaactaaagttaccttcatatgtgtcttttgtcctatcctctgttatcttggaatacagcaattctaactgcttgccaaggttaaattacacaaaaatcattcccaactgttacttcttcctcactcactacagtcaaattttctctaagttctatttagtattcgtccttatgaactttcagatctacctatcctttcctctaaggcctactgtcctagcttagaccaccaccattcttcatttgatgtcctccctgattttgaacttacctcattctacttcccacagtgaccagagagtgatctttctaacacaaaaatcagattacagctttccactgatataaaagcctttaatggttcatcattttctgcagtaaaatcccacttccttggaataaccattgcagtctcttactacctttcctatatttcttttgatttcttactatactgtttttccacaactttgaagcatctgcagttccccaatacttcacattaactcattcatttggcctttcacaagtagtgctccccacacctgaaatgtcctccctcccagcatagcttcccctctattgcctagttaatgcaaactcattattcaagacccagctaaagcattaattcctctgaaagtctttcttactctcccaatataatctgaattagatgtccctcatggcattcctctattaatgtaattatcacatttagttatgattttttatttatctgtctatcctctaagttataaaacagaagatgtaactttagaattaattttaaaaggagggcagttttctgccatgtaactgggagcataaactggtaaagcctttttggtagacatcttggcaatatctatcaacataccaaatatatataatgtttgacccagtaattctacctctaagaatctcttccatagaaatattcagatataagtacaaaaatatactattaaatgttcatggtagcattgcttagaatagcaagaaactaagaatgatcatcattaccacataacaccattcaggtgtttaaaaatactgactttgaaaggcatattgctaactgaattaaaggcaagtcacagaaaaatattaaatcatgcccctgccaatctctacgctgacacacattttatctatgcaaatacatggagggaaatctgggaagactgtaccaaatagtcaacaatcattaaatgtagtcaaaagactaaaactcctaagttctattccatatacttttactaggaaaatatatactcctatacactttcttaaagagaaaaacatattgaagaatacacattaattaccagcataaaaagaatgaggtaatatcaacatcactttatagtctacaacagtctaaaacagaacaaaaaacatcacttttcaataaaaccaatggtaagcaccacagaaaatgactctctgaatcctgagtatgatttttttaaagattttttttaagtaagaaaaaagtactcatcaacttgtgctctggccaactgaatatcttctcttagaaggcagacatcgacattatgtcagtctgtgctccttagaaaacattcttcttcaaagttcaaatgagaaagcatgtgcttgctctctatatataaataatacatttcctagaggtggaaatttgtttttggcaatatcaagttaccctctctcactctgcagaagcttcagtacttgacatttactctctcttttctgagatcagactgaaagaaagaagcctgcgatcctttcaaacataaattgattatgtttcagtgtccctgttggtttagagtttctgaaacacacaattctcacaaatagggttgttttgttgagcacaaatacaaaataagacagcattaacatatacaaactcaagagaagtactgacactctaccacccctcttgaccctgacagctcaaataaatgagcagaactgaagacgagctcattagagaagcaggaaaaacacaggatggggatgtgaccaaggacaggatatctttaatacgtggaattaagactcttccatcattacctggaattattttttctgctttccctcattcctgtgaaaactctgaacaacactttttcataaaccatttgatatggtttggctgtgcctccacccaaatctcatcttgaattgtggttcccataatccccacgtgtcttgggaggtaattagattatgggggtgttccctcatgctgttctcatgatagtaagtgagttctcacaagatctgatggttttataaggggcttttccccactttgcctgcatttttctctcctgccaccttgtgaagaaagacgtgtttgcttccccttctgctatgactgtaagtttcttgaggccttcccagccatgcagaactgtgagtcaattaaacctatttcctttataaattacccagtctcgggtattaataacaatgtgagaagggactaatatgccattactataatggatgtttattcttcaagacagagttgtataaactccagggataaataaaataataaatacgcaaaagaaagaaatgaacactctgaagcaagagcctagacctattaaatttttaccaatggatcatttcagtaacatgaaaaataaaaaatatatccagctggaccttggggaataagccagactcagaaagatgagtactgtctaagtccacttacatgagatatctaaaacagatatcatgtaagattttaaattcataaaatcagagactggaacggtggttaccatgggctggggagagaggaaaatgaattgtcaatcaataggcattaagtttcaattaagtaagatgaataagctctagagatctgctgtgcattgcaactatagtcaacaataaggtattgtacacttaatacacttaaaatttgttaagaaactatatctcacattaggtgctcttacaagttaaattagaaaaaataaagaaacaaatatacctagctcagagacctagatcagactatagcaaatatttggtttctaagacatcctaagaaaacaaaaaagtggcaaagcaataattccttttttaattaagaaattagtaacatatagaaaagtacttaaaaatgctatatccatgtgccttctactgagattaaacagataacacttccagagatatgctttatcttttaaagaaataaaatttggccagttggggtggctcacacctgtaatcctagcactttgggaggcagaggtgggcagatcacttgagcccaggagctcgaaatcatcctgggcaacatggtgaaaccctgtctctacaaaaattacaaaaattagccgggtccgtggtggtgcatgcctgtggtcccagctacttgggaagctgaggtggaaggatcacttgatctcaggaagtggaggctgcagtgagctgagactgcgccactgtactccagcctgggtgacagagtgaaaccccaccaaaacaaaacaaaaccaactttatatatgtaagcttcttcattcctctcctccagtaactaatgcccttaagttcctgtgttgtcattccaacatatgctcttatactaaatacatacctctccagaacaccattactcatttcaataatttctttaaaaaatacacaaatgatataaccatgcacatatatttctgcaacttttaagtcatcattttttgagatttactcatgttgccacattaagtactgtacagaattctatggattacataattaccatttattaatccacatctctacatagggccaattaggtgtatcctacttttctatattacaaacactgaaatatatatgtattattgtgtacatgtgaaaacagcaatcattattatgtatgaaattttaaagaaagcctaaaactagaaaatagaaataagctaatctatatactaaacagaaaatctacgatgttccaaatgtgtctattttataatggccacaaaggaagagatgtttttcatctcatatgctgctttcttcctttatattttaagaaaataaaatccctcacaaaatgaatatatgttttacagtcataatgactacccaatgtgccttcattatatcttgcttttactctgttccatgaatttcaagaagactgaagtgtgtgtgtgtgtgtgtgtgtgcacacgcatgcgtgtgtgtgcgtgcgcgtatggtagggagtgatacttgctgcctcttcatcctttacttgttttcttcttaaatctggcatatggggaaattccagttatttttgtaaagcaggaaactgagcaattcataaaacagattcctctgttcaactccgagcttgtacaaatgaccagaagagttaaaaacaagaaaagagagaagatacttcattgcatcattatttcaaaactgaagtcaatgcaatgtcaaactaactttgctggtgggaagacagtgatataatcataaccattatggtcttctcataagagatcataattgcctattctttaatttctttgagttaagaactttgctggcttgaagggctagattattcctatggtgtagcccgatccctagatgaaattaaaacactggctatgaggatgtgacaagagggaagaaaagcaccatatgatcttcatcacttaaacttctaagatattaaaagggtagtggggaatatgggagatagagacaggctctaaattccttcccacaaacataccacttaaattaaaaatacactgaaaagtgagcaaaatgagatatgaacagtcacttctccaaaaaaaatacaaatgaacaacgagcacatgaaaagatgttcaaactcataaatcatcaaagaaatgcacataaaaccaaaatgaggtatacttcacatctactaggatgactataatagaaaataacaagtaacaagtattggagaaattggtagtgaaggaaaaacagaagaaataaaagaaagccaaaaaccattttcttaagggaaattgaacttgaaatgagaaaaatgagcacttcaatatgaaagtatatcacgtcaacagacataaatacatctcgacaaatttgatttgatgacaaatatgtcaacgattcagtggtatcaccactaagaaagataatcattattctagcaaagagttgttgctagaaggcacagaaattaggagcatagccaatggagagaaagacctagatcacgaatctggttttaacactttctaactgctgaattgaggactgagactgctataagttaaaaaggccagtgtgacactgttccagtggaagggattgcacattaaggagtggcttatcagtggttctcttacttactgagcatcagaaggactagcaaatatgcagattcctaggccctgcctccagagattctgatttgatacatctgggtagaatttgagaatctcatttctaacctgcccttagggtaatgctaatgctatccaaagaaccatattttactgagcactggtttggataacatgacattctatttgcgtagttccttaaaagaaaaaaaaagccaattacctgacttttcagcaggttttagaaattatgatatctctggaggaaaaataaggaatatgatataataattagcattttgaagtgcttatctataagttactattctaagtactttgcataagtttattttatctaatcctactaaccaccttatgaggtaagtactcttatctcctcatttcataaataaggaaagtaagccccacagaggttgaccaatttgtctggtattatacagtctgtgtgttatgccacatatgtactgctaaaaacttttttttttttttttttttttgagaaaaataatggagcctcactctgtcacccaggctggaatgcagtagtgcgatctcggctcactgccatctccgtctcccaggttcaagtgattctcttgcctcagcctcctatgtagctgtaattacaggcatccaccaccatactcggctaatttttgtatttttagtagagacgaggtttcaccatgttggccaggctggtctcgaactcctgacctcaagtgatccgcccgcctcggcctcccaaagtgctgggattacaggtgtgagccaccgcgccaggcctgaaaacttttaaatccagtaaaatccatatatctgaagttgaaataactatatacatgtatggtgtgggtaccagctaaagataaaatgagagtattctttgcaagcctcaaaaaaattctacagacatgaaaatgagaaaagaagcattttactgaaaaactataattcttcttttctattttacaaacatatttatcttttccaaaatggtaatcactcctctctttaaaggaacacttaatgaatttcacataatctgacttcatataattaaaattatcttcttctagccacttccttgataattaagggtaatgatagccaaaattcctagaagacaaatttaacttttattttaaaatcatctagtgacagaagtgcttatgagtcaaaattattttaaacatcatttggctaatggtggatcgtctactgaaagattaatgggtaaagattacataccttgtttttaaaataaacttcaattggcaaaatgaaaccagcatacccagattcttctactttgtaaggtggatctttgcacactgcaacattaaaaaagaaaataggtaagatgagaataatagacaaaaagacattcttcttttaaaaaaaaaaatcccattctaccatctagatcacacgcaattttcatagccccttgccaaactcccagttgagtctccgatctatcctttatttcttctccagaaactataacaataattgctcttatgtaaagcagatatgtaagtcatttattcaaatcttggtggagaatagctcatcacagtcaaccatgattattaatgagtgaacttcacttgttattaccctgcccaaaagctttagggaaactgatgattgctccctatgacccaaagtttgaaaagaactgtaagcttcctaacaagagtattatctgcatctagtctttgatgcaaatcactccccaccttaacttctgacttgtctgagatgtcctgacaaggacatctttttttttttttttttttttttttttgagacggagtttcactcttgttgcccaggctggagtgcaatggtgtgatcttggctcaccacaacctccgcctccctggttcaagcaattctcctgcctcagcctcccgagttagctgggattacaggcatgcgtcaccacaccaggctaattttgtatttttagtagagatggggtttctccatgttggtcatgctggtcttgaactcccgacctcaggtgatctgtccgcctcagcctcccaaagtgtagggattacaggcatgacccaccatgcctggcctagagatgtcctgacttctatgccatcctctttccttagaaaatcccaaacccagagtttctcaatgatgcataacctccctccttcacccacccaaaaggaatgtttactaaaataccaatatacatgtaaacacttaagatctaatcacatcataagaatacataagaaacaataaggcttttatttctcatggagttaaaaggaagcaagactattaggcaagctcttggggaatgagagaccctaagaagccaaacaggatttcattccactaaaatttcaattaaacgaaaatcagtcacaagccaactgaaaccattctagttaagactgcattttggtggtatcacaaagtaaacatgtacatgccaaatatcaaggccacacacactgatgccctgagtcctcttcagcagccccagtttacctgtccttttgtcacctaccaaaacccctctgcttcattccaatgcatttcccccaaatgtgcccagcatttcccaccagtgcctggtcctccttctatcccttccaccacaccttgaagctactcttagtatcctctgcaagttcaaattctactttcttcacaagatctttctagaccacaaagcattaccatctcttttccttttatcctcccaaaaagttaactgcctgaatcagtaccttgacactgaacagagttccttatgaccatattttgaaggatcttgtctgctaatttcctttcacttctcaaggacaggaagcacattcacctcaagaagatagagtgtcaagggctcaggcgacagcagcccagaatacttgggtaccaatccatgatcctcctcagactaggcgagctacctctgcaaaattatttcatcttagatctctgggttcctcttctagacaatctgaagactaaacaaggtgaccgttacgaactgaatgtttgtattcccctaaacctcgtaaactgaaatcctatcaggaggtaggaacttttgaaggtgattaggtcatgaaggtggaaacctcatgaatgggattagcaccctagagagctctcttgccccttcctctatgtgaggacatggtgagaagatagcagtctgcaactctgaggagggcccccaccagaatcccaccatgctggcactctgatctgggactttcagtctccagaactgtgagaaatccatttgtgttgtttataagccatccagtggatggtactttgttaaagcatcctgaatgggtaagcacagtgatgtgtgtaaaagatgcagcacagggcctggcgcataagttctcagtaagtgactgaagccagggaggaaatctaaacataaaacacccaattgccatgtagccttttggatgaaaataaacaggatgcagcaagcaagagccctagatttgggtcagaagactcaggtccacagccctggattgaatattctctagacagcctacattttctctccctttaaagaagaggaaacaccatctacacaactgaaggcacagccatcgacatacaaggagactatatgtaaggaaacagaagcgcgaggcatttttattacagaaatgatgttgataatgtacctggaaattggttagacattccacaagcagaaatatggttacaaaaaggtaaactgaagcccaccttaggaaaattgccccaaactgacatccgaagaagtaaatcaagaatgagacatctcacatgaccttataagtttctctaatagaaaaacgaaaacgtgaaaagatccagagtggcttcagtcttgcattcactgaccacctgtcaaccgatcatgaatattcaaatattgtgaacactggagacaagtgagagagtctcactaaacgcattgagcagcccccaccccaccttagcaagaaggctagtgttacgcttatgacacttccaggctgcaaagccccttttcagaacagcaatttcagtgtcaggttgcttgggattaatcatgccaatgtcattggaaggtagtttattttgtgggctgctgcacatgccagagaagttatacctgatcctctatataccctttagtataattcattttctctattctgaatgcaaattgctcctattaacagaaacagctgttaatgagcacatcttatcgttgaatatctttggatttttttttccccaccctttaaaggaaatgacttgctacgtactaatattgtatagaagtgtgattttataagaaactgtttaccaattcatataattatttttaaatgcaacaatttcatcaataacaatgaacaatgtctgtaaacccctgagttcttaattagaagcaaacaacaggaactttttacacacaataaacaggctagaaaatcagtagccatgtaaataaaaaacttacagttctaatctgaagaaagtcaaattaggggaagttgtttatttatttgggtattttatgatcagaattagtatgagtttcttagttcaaaagaaacagaggttaaaacttagaaacattttagccagtagggatactacattagatataaagcaattcttttttaaacaagtagaaccatgtttgggagggatcaccttctgtcacttgcaacacttcttcattgagagtctcttctctcactgcatcaagtttatgatagctaagcattctaaaccctgaaactaattcttcctcttgattgttcaagaatcagatcatccttaagctctatgtcataaaaggccaagtttcagaagctactgaatgaatattcacctttagaaagccattaaaatctttaggtgacaataaaatgggataattaacatttactttttaaattctcatgttctattatatgcatatgcattctcacatattaattcaggcaaaatcattaaaagcttttttcatctgtaaatatccagcccagatgttagctctttcagaacatctcccttggctctcttccataatcttgttgcaatgaacaggtcagaaggtaagtcatttccctctcagactcctccactagacagacccccttcaaagtcagcaaccacaataattattcatctttgcaaggcctgacactaccattgagccaaataatatgtacccaacaaatgtttgtcaaatttaacttttaaaagactcatgctacccttcactgatttaccactgccaaagaagttgtttttccaaaagaagtggtgagttgacagtaacccatcaaattcttctccaaactcgctacaatcaacataaacttttaaagcttttaaaaaattggcacaggtgatagaaaagtgttgccacagaggaaatttttcttgagtactgtggaactggtcctagttctgagagcaccacatgttaagcaattgagttaatcaactgggccagaagatctctaaggccattttgaaactaatattcaacagccgtaaataaccgctccccttctcctctccatccacacattactacccatgtactccaagactctaattgggagaggttttcaaaactctctttgtctaattaatcccatgtaccatgtaaggtctattaggatactataatgaaaattcatgcctgagagaaacagaccaaagtttttgtttgtttaaaaagaagtgtaattgggtttaattgcatttttccctgaaatgtcttttcaaaataacagacacaatatagattcaaatatataatatgtagtatgatgctaaccatacattgaccaataacctatttaatttttagttggaaaacatgtacacaaggaagaaaaacacatggaaagggggaaaagaaaatgatctggcaaatttgcaataagcaaggacttttaattagttagaaataagtcaaacccttacttattaaaagtccttactgaaaattttaatattctcgtttagaagtaaaagatttgacgaagagctatgcttggtacagagaaataaatgctctgtaaatgaataaatatatttgtgcttatataataaattacttatatatattcaataaataaatgtaattaataggaactatttttttagcaccaaaagaaaaaacgctgccaactccataagaccttcatttaaactttagaagtattattaggcaacagttttttcccgaaacctcaggaaaacagctggtagattcctctccagagcatccctttaccctatttgttttgatgctatgatttatggccatctgaatacttttgttaagaacatggcccagttgcccattgataattattggctttactttatttactgtgcagagagcccttcaggaaggaaacacatcaaactctctctatatatagactggttattactactgctttgtgccaaatgtcccttccagctttagtattttggactccctcacttcctgcttcacttctaccacatcagagcctccaggaatggggcaaacaagatcctgttcagcccatctctccgcacccaaactgttctgcacaagcatctggaagtctagagccagcgtctgaaagtctgagcatcagagggtagcttaccgcacctaccactacaaggctttacagtcaagacattttgaaaacaaaaatcaacagttgagttttgtttttatttttaaaagcacacacaaaaagattcaccattgattttattcatcccacttcaaaacagattattcctaaagaacaaaattttaaaaagttttccctcttttgtgttttatttcctccatttccttgaacaagaattaaagataacatcaacaaatacattgagttgtatgttgagttgttctcaccttttggatcttttaaaaaattcaaatgcaattctaaaaacctaattgcttcctatacaataaggaactgtagccacccaatataactgtctaattaacgttcataaagttttaaagacacaaactagatacagttagcggagaagatgcagaccacctgtccacctcctctggactcaccactcaaggcctgactcaatagcaccacctctggagagccttctgccaatactcaaaacaaaaaatggtcatttctctcttctacctttttctcattgcatcatattagctaatcctaatacatctgctaccatcaagtcccatcctcatccctacttaattcagagctttccaaaagctaatgctgtttcccacacctcctctcgttccttatcccagaccatcatttatgaaattgagtaaatttgtgaaacataactttagcatgagttttaaaagaagggatagagtaagactgacagttgaggataaagtatacaaggcctgggcagcaagcagaaagtgtgaacaaaggcatcaggagagtaaaattcaatataatgagacagtcggtataagcagaaacactgaaaacaatgaaacaacagacaatacaaataaagtttacatttgtatagagaacgtcatgctacacacactcagaaattcatgtcaaaagtccatgaggggaaaaatggattgcactcgtaaaggagggattattgaatttgaaatgttacagagaacccctagatttggaataagaatttgagactccaaattggctatattgcaaaaatcttaatgatgatacataaaaattacttcacttgttagtaacttggaatgtttacttatgtattcagtatatccctggcttctctttcaagggggtgggggggaggagaaattttctttaacatacgcacaacattttcagctttctaaggagtttagtcattagagttagcaaagcccatgtagctgaggttaagtcaatacatttcatcttgagggaatataacagctatgttaaaacaggactgctttcacaatcatttcttcaaggaacgtataacaaataagccagcaaaattcagaagtttcccaaaactaggtaatattattaattgctaggaaatactaaatataatttctcaggcttacatctttcactaaaattgatagtgcttctcctagcaacttcccccaagttccttcaatgtaactcagtatacagaattgtttcaaatgattagcctagtggacacagatgtccaggctaatatgatgggaaatagaaaaactgtatcttcagagaaggttcaacctagaaacagacctaattttttattgaaaataatacaaatggaaaaatcttgagacttgtattccaagaattattatcattttcttaaagttaaaccttgggcaaaatattcatatttcagaaagtccatctggaaaagcaacactagctacacagaaaatgatcttctaggaaagtaactaagaactgttcccatatttggtgggaacattttcatttcagtgtgtactactacatcataaaagttggtcatctgaaaccccagttcttcttggtggctttttaaaataaaatatataaaaaaccattgaagagtatcacttcctaaaacaatcgccttttgatttctgtaggtagcagaaaaaacaaaccttgggacagccctctggcatcaaaattttacccaggcttccatgtactacttctggccgagccattgctaaaactggaactgttttttatttagaaaaaaaaaaagaattttaatgtgttaatttataaaattatacttttcattaatattaacgcatttcttctcaataataatagccaaattaattaaattcaacaagcactacaaaatcttaaggctacaaagataagacgagtcctgctcagtctaaccagagaccgttgcctgctaagtacaagttctattctagggactgtggatagagcaataaacgtaattgacaggtcccctgcacttaataaacttatatccactgttgggagacaaagggaggaagtggagagaaagacaacatgcatatataaaatactgagaaagtactgagtgacaagtgctacataaaaataacagtatagaataataaaagtgttatgataataaaacagacttaaagaataggagctcttttttattttagaatcatagtccctctttaaggaagtggcatttaagttgagacctgaaagaaagaaaaaaagcggggagggtatgtgttggcctggcaggaaaaaatgacatttatattggttacagaggaagatgtgcaaacaatctaaagcctgtccttatattcacctccagcactacttagccccttacctgatttcttcctgtataactgaggtgaaagccatttcttccttcctaaacatttcctacttgggcttctcttccatgaattcaccatgtaataacccacacaggtctggctcttataatttcatgataatctcgtttctcatatcttaaattctcctaaagctataaacccccaagagcttataatgactctacattataaagattttataagtagacataattcttgggaatttatataacctattttttctttttcaatctgtcccttgaaatttcagagttcctaaacacaatgaatgtggactaaggaataccaaagcataaaaaagcagcagattttgagtgcaatttaagaaaaggaaagataacaggtgaaaagctatctacacaagggagggaaatagtgttgcaggaaaaaaattacatggttcaggagagaaaggggaaaagtacaaaaagagataatgttcaaattattaatatacagtagttctaattttctcaaacgtatattcaccttaaaaggataattttcaactgaaatagatgggtgttgttcttttaataaatgcactgtatgagagttacttttaaatacgctacacccatattctcttacctaacatgaaatttcattttttattctgaccctttttctccaaatgcagaggacaacaaaattgtgttacacacaacagttatcaattgcatagggtgatagaaatggcaatgtgttataaaataatcaaatataataaatcaaaattaaaacccatttctgagttttaaaaaatagcctaggagaccatcagaacctaactcgacagaaacaccaaaacgtgatggctcaatattaatttttgctttattcccttttccaggacaggatccaaaattgtcctaacttcagaggaaggattaagaacaagatttcttttcagcatcttgtgagctctacttctttttcccccctgcatggcatttggcatagtggtagcctatcctaaatatcctaattgatttaaactccattaaacattaaaaacaaagactgaatgagggtgatgttaatatgatgacgacagtttatacagggtacatataggagtacagtttctgtttaggctgacaatctttcaatcttcttcaagaaaccagggaaaatccagtttctccacttttctcaagcaaggatttccaaactgtgttccaggaaaccctacatccttgcaagctgtttaagtgattctacaaaaagggtatttgtcccaaacaatgaaaaactgaacagtggaaggactcatcctagttttagatacaggttgaatatctcctatccaaaatgcttgggatcagaggttgattttggattttagattttttaggattttggaatatttgcctatacttaaggttcagattttaaatccaaaaatcccaatccaaaatgctccagtgattatttcctttgagtgtcatattggcattcaaaagtttcagatttttgagccattttggatttccgattttcaagttagggagacttaacctgcacagtgttagtgtccccttaacattatgtgaaaaaaagccatggctaaaacaaaatctgaaaccactgttcaaacgcatttacattatgaagttttagctatatcatttaagtaaacctacttttacagagtatggggtttttttgcttgctcctatcaaacatagtatcagtttactgttttctccctaccctgactatagaagtgagaaacacacagatctctcaggtttgtaactctggcatgtctttgggctaaatagataacaggataaagaacagcttttattcaactctgcaggtcaacttttacaaaataccttctgattatcaaatgtggtactaattgcatagtatctctcatggtctctgaattgcaggaattactaagtagggggacaaatataagagcacaaacataaatgaaagagaaatcaaaacaaacataaaaactactagtagtcagtgttataggaggttgctcacaaactgaaatgcttagggaacaaaccagggagaagcagagacagagtcagtcactggggcttaatattagtttgttttaaaggaagcaggtatgactgtcaaaaggaagaagaaaataaaattctaatgagcagtaatgattctagaaaagcttggtataagtaggttataatacaagctagagtatatatgaaacattccacagtagagcaactgaattaggtatttcttaacagttcttttcaaactagagacactatgaaaataagagggaggttaaaaaacaaaaagagagagagaaccggatattggcaaagagtttttttttttcaattgagacaagctctcactatgttgtctaggttggacttgaactcctggcgtcaagtgatcctctcgcctcagcctatcaactagctgggactacaggctgcaccaccatgccctgcttaagattttaaaagttcaggccaggctcagtgactcatgcctgtaatcccagcactttgggaggctgaggtaggtggatcacgaggtcaagagaaggagaacatcctggccaacatggtgaaaccccgtctctactaaaaatacaaaaattagctgggtgtggtggcacgcgcctgtagtcccagctactcaggaggctgacgcaggagaatcgcttgaactcgggaggcggaggctgctgtgagccgagatcatgccattgcactccagcctggcgacagagtggcactccatctcaaaaaataaaataacaaaataaaaaataaaagtcgatgagcagatttaatcttatttaggagtaataaaaaatcgctattttgagaatagaagcaaaggtaaccaaataatgcgcaaagcatattgcctattgccccaaataaacaaagagaacagagaatacagaaaatgaagactaaatacgaagaaagaggaggaaaaaggaggctgaaggttaagatgctgtcagaaattatgactgtacctcaaatacaaaagtaggaattatcatgtatgctgctgaagcttactgtaataattggcaggtgttttcctcacttaaatcaagggctcattgaaaactttaatttagcaacaggcagcattttgcggaagaggcaggtatgtataacgtggagacagagaagtttagtggtcgagagccagagcctttgagaaagatccttaggttcagatcccatcttggacatattatgttcagttccctcatttacaaagtgaagctaatgctattgcctacttcatatagctcctataaactgtaagaggttatccatgctagaaagcatgagatagtcccttaacttttaaaacactttctgaaaactagaaatcactcagttatctaatagtagtcaaatgcaagccataaatattagagaattttttggacttcttcccccaaacagtgaaatacatatatttgccatcagtataattaaatattcctaaatttgtttttatttttgctgtcatagctccttgacagggatatgtgaaaaaagaaaatgttcctcacttggagttcttttagctcaatccaccactaaaggtactattagcagtgaggccacactaatcagcccacctagaaactcgtgaagcccaagtgagcacatattgtgaaaaagctttaagtaaggcttccgaggttatgtactaaagcaggaacactgaaatactgcaataaacaaatgagtagaaaatggaaatgtaatctgagtttgagtcctgtgatgcagtaaaagaaaaattaatggggaatcaggggacctggttctggctccatttctatcacaaactagccatttgtcctttaaccacttactctagccctcctctgtcacataagaagccagcttccatttcagaggctgcttccacatctaaaatcctaacattcaaaggaccgacgtcatatatgttacttctactctaacttgaaagcaaatgcattttttcattatctttgtttaagcataaaacatttatcagctaaacaccacatctgctgttaacacgatcaggaaactgagacaaaacaagcaaacaaacaacaaaaacgaagggatttaaaatcacacttgaattgttttaaatatatttggtaaagccatttttcttaaagagagaacaactatattttttattagaccattaaataaaggaatactaaataaaacaggaaatactaaatataaaggaatactaaatattgcccccgtgcaataaaaaataaattagattttcattgtttccattcttacttgggagtcaccttaaatgtgtcaagtaaaaccctgttttacatgtataaatcaaaccagcaatttgattcctcaggaacttggtataatttagttagagtggcatatgaactccagtattaagaaatgaaacaacagaacatacctggcagcatttatgagaaatatcatgcctttaaaatggtaaaatagaaaattaaatcaactgtttgcacattaggcatagcacgttatgtaaaaagctcttgaatgttatgatttttctatatattgcacttgtaacacccttgttcttaatcacattgaagcatattacattgctttttaaatagaatgcaccctgccactatgcagtcaatcttaatagtattccagaacagcgtgcccatatgaaagataggttgatgaataggtttatgccctattcaaggagatgaaacagctcaatagaaagattaaggcttctgccagtagttgaatcttaaagtcaaagagaagaacacaactcaaaccaaatgttacagacaaaggtcaaacaagagaataactgagagcctaacttgaagaactagctagtgttcactaattcggtgcaatcaggaaaaaaaaaaaaaaaatctctcttcctaaagagtgaccataataactttcactgagtctgttttaaaagataaattataaaactgaatgaaggtgagctaagtcccaaataatattcacagggaaccattcctattttgaatcgactggaacttaggtacaacacagattaaaatcttgctgtcatattgtaatttaaaaataaattctagaactataaaatgtcaaatattaacagaagtatgaattttggtaaaagccttccagttaattttgtgtagaattctattatagtctaatttatttatataaaaagaaaagaaattttatgaagaaaaaaacagcaatttgtttcccaagtattattttttgttgacttgaatgtccagtcaccagtttcaatctcttctaacagggtatttaactaaaagatgaacatatacttctcactgtgtacacatactaccttcaaaatggaaatacaaacttggctctaggaaaatgtggaaagtatagaatagtgctaaaagaatagaaaaaaatgtttatcacgttagtagcaaatatttgggaggcattataatcccatcttgagaagcctggtttatttaaatttctcatcagacaacaggttcatttgtgttttattaaaaaaaattgctctccctgtgtgttgtcatttcgtatgttgaaaacccactatctaatttaattttccctcctaaatagcaacgtttttggacaatgatgctgatatcagctaatgaactaagtaaatcatgtgaattagtatacctatgtcaatgccatgcccaggagtaaatacaatcaaccagaaagactaccaagaaactgaataagctttacctaccttatcaattccttttccttgtttttctgttttcatcaagaaatgctggtagataaattccaaatccatctgactctagtttcttcctgggatgtcaagtactattgtttagcttctaccctaaaccaaaggtacaaaggagggtagggagggagtaataaactgaacaatagtacttaacaccacaggaagaaaattttaatattttaaaatgatgctttatgtataaatacatgcatttgctctcacacatacccccttctaaataaacacatatcaaacattgcaaataagtcattttctttcctacttgcaacaaaaagcagtgagacatttaaagacagccaatttcaaataatttcttccttggagataacaataaaggtatgatttatttaacacctttcatcacgtccctgaaagatcactgatgtcacataaatctataacataaggaaataagtagctcaagagctctgccagccacccttttttaaagatggaatatgacaacttaagcaatttactcagaggtcagtgagttaattcctagcattcaatcaatagatatttattaaaggcttctgtgtagcactttgtgctggatgcttatatgaaaagtatttttttctttttgcttatttggatcttctcatttttctacaaaaacaaaaattattacttgtaataataagaaaaatctttaaaacagtaatgcgatgttgagtgaaattaagaggaattcggagaaatgcaaggtctctggaatttgaaatattcagaaagtcaaggaggactgaggtctaggtcttccacctatgcgtactttccattctacaccttttcctatgaaaatcacacaagaaacaagtttataaagataccagatttagagccagctaaactgtgttctttgctgctctgacatttcctagctgtagtaattaactttaggtaggttatttaacttctctctatctcagattctcctatccataaaacaatgaaagcatggctgtgcaaattcaatgtaacacattattttatgagaaacttgatttgtaaatgctaaatgcctgccaaacattcgtcttaaaacatattttgccaacagttacgcttacttccactaaatggggacaaagagaaggtgccactgagccaaaacttctgactaaccaagagataggtgttagaaatactgagacataattctgcccctaaggatgtcacctaccattttttttttttttggatagaaaactctagtaggatgtggataatacacttttaccaccaacacagcaacacagctgtttcttagctaagaaatagcaaggaaaatgaagatcctaaaagaatatattattagaatagcataatactgttaaactgttaaggtgaaataaatgacataaatttggaagttcttttacaaatatggtttacttgaacttcatgttttagtttaatgctcttattatctctccatggctttaattctagcttcatttagataatgtgttatagctatcaaaatatgtttttagggatttgtttttatgttaaaacccagatattatttaatcctattaggattttcatttgccttaaatttactgacataacagaaactatattaataaactagtatgcaaatttttcaagttaccatgtatttcctgggataggtttatattctgagatggttccaaccctcaatgccactgccatcacctattttcaacatatgtgttgccggccattcacttattcctttcccaaacatcgcacatttattatacaccaggactaagaatgcaagcatgaatgaaataagggcttatcctcaaaaggatcatagttaggcattttctgtccaagcattttagatcccagttaagaatttcaagtactgcccacccctaccactgggggttgggcattaaacaagtgaaggtgccaagtctttagcagcagtagttgaacaccctagattgaacaaacttcagatgggcttaaaccaactataaagaaaaatatatataagcccctgcatgtttttgaagaaacagttcttgttaacaaccaaagaaaaagcttttcataagctataagtgctaatacaaataccaagcaaaccaaatttagaaatatcttaacttctaaaccatatcctttctttaatcatattagttcagcaatgtaattgcaattcaatcctctcctagtcattcaaaagttggccacactcccaaagaaacttcaactgctattctttccatttatttctttttactagcactatgctaacaaaaaaaaaaaagaaaagaaagtttcttagctaagagtccattagtttaattacacctagaacagtggtctcaggatcagtaacaccagcatcacctgaaagactttttagaaataccagtttttggtctctactctagatctcttaaatcagaaactctggggtagtccgtagcaatctgttctcctaaatcttccaggagattccgatgcttgctcaagtttgacatccactgcactagagatcttctcatatactcacgtagtcaaagcaaagatgttttctctttgcaaatcactttttcttattgcttcagttacactgctattttttcgtccaccaaatggttaaagttacttctctcatctgaataattacatcgttttctaaaacacttttttaaaggagcatgatgtacaatcatcccctaaaaatttccttttctgtataacattattttaataatacaaaaattgttaataatgttgagtttcaccaaatgtaattttaaaaacaaagaacaacaacaaaataaaatgttcaagagtaaaattatgatccttaatgtgataacaacactagaggtacgtctgtttactgttcaagcaatcactgccaggaagacatagacacagtcagggaaggaattttctaaacatcagaggctaaacaacagttgcttttcattggttggtaaagaataggactgggtccaatattcaagcttaatccaccagataatactcaaacatttcccataagaactgtcaagaacatagtaatctcataatgtcactgctatgaaaaccatttaaaaaaaagcaaaagacaacaaaaaaactaactatgctaataaactaaaaaaacaaagtagctgcagactgcttcacaataatggactcaaagcctggctcatatacaacaatgaagtacaatacataaataattattatgcaacttgtaaattactactgtactttctagtcactgcacaaatagaatttattctaccacactcttgcttcatgtctgttcctagaaggccagagttgatgcccaatagaagtatcaaatgcctacagacttggaataaagttgattcccttaaacgatgataatataaccagcctctcgatactcaggacactgaccttgctgcagctgcttttgatttccaagtgtcggctgggagtgtctttttcggtctcttggctcctaaacttatgatttatctttctgaagccctcgacaccatttctataacactctaattattggactgatttgaacaaaagattcttcagtaattttggcttaaaaccacatagaaatttttataataagaaatgtgtaaagaaaattggagaagatttgaagtgatgaaagagtttatatctgttatgatctaaacagaacaccctggaaattagcttgtgtagatattaatgttcaaatgcaactatgaatacttacattttcaatgactagctgacccacaattaatattcattatgtgaagccaattactctcaaggtattgctgttaatataaatggacctaccctatcttgtcattctgttcctatacacgagtctcctcatccatatactacaaggctcggtctaccaccaaaagactctgccttcattcggcggagaccctgagagacacccttgtattccatcctaatttgttttttcccacatacagccccctctctgatctagctatttgcttaagaaaatagtgccctataagcagtttgaccaacgaggggaaaaaaaagcagaccaaagggcatcctatgactataatgtaatgagggcaattttctcccacagctactaagctggttttgaagacagcatccacagaaagcacttgaaagaaacacactcttttgcaaaaaatatgttttaatatatctattccaaatctcatcaagacttgaatatttttaaatagctaacaggtaaaagggagtagtgttctaaatattggaggactttattacatatgtccacatccaggagtaaactagagtaacttaatgctatgaatccaacaaagagctgtcagcctagtacaccaacccatcaagccaaagctttaaggctacttgacactataaagtaatggcatgagaaatggccggggggtgggaactgaatgaatgaatgaaaaatccattggcttaagagttgattcatgcattttaaaggtcagtgtgatttatacaactttaaaggctcaaggtgaagttatttgtgatgggatggcagctctagtaggaaactcaaatacagcagaaatgtcagccacttgactgttaacgactgtgctttctgcagtaaatttctacaatgtgaaagagggtagccaaacaggtatctctcaataattcacctaaaaagacttatcccatcccctaactcttaacaacttttcacaaagatacccatcaaatctcccctcttggaagctgtcctgcactttatcttaatggtataatttcaaattctgatctgctgcatgaaaaagaaggcataaatcagcttcagttaagaaatatttaaaattttgttaacatataaagtttcatacaactgtctactattaggcagctgtattgaaataagtcatgtatatatgaaggacaattcaacaggatcagaaatatattatttatagctgattaaatatggtatttggtgcatttgtttaaaacaaaacaaaacctggttcaggtccccgggtcaggaatggaagctcctcattctcacattggttttatgggaaaaatcacatttgacttccattacactgatttacattacctagctataccaggatttggcacaatttaaatacaagagctttttacacaccaaagttgagtcctcctccaaaatacacacaatatttcatttcaataggttgaagggagaatatcagtaaagctattggtcagtgtgttatttcagttagcaacaaaattgtcctactgaaacaaactatgcgtttcactgatacatgtttttctaaatagcaaatatgataatgctacctaaaagttttcccagttattccaaacttatttatttgattcaaaaacaggaaaattattgtctcaacattaatgcgctgttttttttgtgtatttttttttaagagatagggtcacattctgtcacccaggctggagtgcagtcacgcaatcatagttcacagtaaacctcaaactctatttggtgaagatatttctagataaaatgccatgtgataaatatggttaatgaaacaggaggagaaatagtacttgagcaatgcatacactcttcagattttgtgccatcttcctacaagactcaaagcaggtcagcaggtttgttttttaagcaagttagagtgacccaaatcagagaaatacttgtatacagagaccctgagacagcaacttcactttaatcgggagttaaatatactgtctaacaaaggtatctcatagatttcagcatgccttatccacatgttccctgttcattacagtgtgtaaatttaagttatatcagtcacttgtaaaatactgccaaaaaatttatatccttaaaacaaataagtaatgtcaacttaattcaaaaataaatggtaatacatacaattataaatcagaaaccaaacaaaagcttataaaattacaccagaggctctataaatcatatggtacctggttgagattccttggaaatgccaatgaaaaccaaccttctaaggatttaaaatgaaaaactttttacatttgaagacagtattttatcttgaatcccttgaagtccatcttaagtggagtattcatcctaaagactgacattttcattgaattctcaatattaaatagaaattgttaagaatgattacaatctagaaaattatcaactagctaaaatgtcctgatttaaatttatatcaataaccatagcatacgttaaggaatctatcctttaaaacaaacaagtcttttccatctgtgaataaaggccaggctttaaaacctatggtcttttgttttttccaccatgctataaacatgctataaatagtttgacagacagtttcacctttaattgaaccaactctgactagaacagggatacggacttttgtctcctcccttctctggggcccagtgggatgaatgtcggagggattccacacaagctttagatgtcttggacttagaccctatttgttttggaaccatgggttcctttcttattaaattcttctatttgccaggagaaaactggaacaaaaatgaaaaagtgttgactttaaggtttgctctatttgtcatgattggaaatttcaaggctcttttttctttctttgtaaggcaacacactctacaagttgcttatgccctttgttttttaaagtagtattttagagagaggagtgaaacaactggagtctctgttttataatggcatttgactaacaaactctgatgcagcctctctcacatccccaactaaaaatctttgaaagtagaccccaataagttaaaacaaactctgccacctaaaactgaagctgacaacctatcacctttatgtgagcttactgtcctaatgaccagaaggatgacaaaactggatagggaaaattttaaattaataaataaataaatagccctcctctcctatatgctctggggcccaggaagagtcacacaacttctccctgggacttagtttcttctataaaataaaggctagagctagtgacctttctggctctacagttctcctatactccagggagatacagagagggtgcacagtattatcaacctaatcccaatggtatgagttatttttgcaagctcacttctaccctaaaatgagatgaccaacactgctataaaagcaacaaagaaagtcctaaagagaaggaaatattttctacgactgtatgtttcacagattaaccaatactggatttaacaatttaggatttcatttttaattaggttgcagaagaagcgctgttccagcctttgcaacttcatcctctatttacagctgccaaagtaaaaagtacaataattatcagaggtggatcaagagaaacaaagccaccttgaaataacaagtcccctaaaccctgccctggggcttagtgtcgctgtgtttcaggcatgacaagaacttgggtagatcctttgcaactgcttggtgatcacagattctcggtggactggcagtggctgcactgagaagctgcatcttattcctctacctctgcagtctcttctcagatatgttaattgaagttaacacggcattctttgcatacactaaggcctttataaacatttctggctttcactaaagagctacagtgaggagaagagatgtaagttctgtgaaaagagttgttctgtcttgtttagcactgtccctcagtgactaaaacaatacctggcacagaagagatgctcactaaccacagacggactgactaacatgcctcttgaaagtaagccagaaatataacatagaacatggctggtgaactgcagagtgagacactgtgccccgtcaaggaacaactcaaccaactgatcgtagtcttataaagccctaaaagcctaggttcaaagatgacctcagatatctcttgctctgcacatgatcactatagttaagatggaagatatagctatggcaaggtgaaaagagcacaggaccgtgaataagatgacctggtttaaattctaaatccactccttaatagctatgacccggggcaagtcattttaacctcggagctttcctcgtgtttaacaagggagttctacttcatagtctagttggatttagaaaagaggccatgtataagaaatcacctggagggaaggagagaaggagaggaaggggagaaagggagggaacttcagcagaggtgaagttccatctccagaaacttcaacacggaattttccatagagggcctggtgtacaatagcagctgtgggaatgctcttgagagactttacaaagaatgagattgacaggaactgatgacagtttggatttgaaggctctcaattaaagagatcttggtctgccctcatctggcagggcctgaattccttctcttatgtgattcccaacatgatgaatctctttaattagagaggagtgggtaatttggaaagaacgatttaaaatggtttcctttacaagtttaaatgtttctaatatgacataatcctgctggctggtttgtttttgtttttgttgttgagggggttcctggctctttttatgctttcaggtttcttaggaaagttgttaactgtgtacttgtaccccaaggcaattactgtgaaggggtatcttttaagcactagaactatttctctaattaatttgctttttatattgttaactgctgttggcctcccttcacatctagagcaacccttttttttcttatagcaagagggaaaatgggtgatttcctttccttactctaaacaaatcctgaaaaactagtttatcaaattagggtccagttctaagctgagaccttttccatttgactcaaagcaagctgttcagaggagaaaggagtaaggcctagagaagttgggtactatggtttctagttccagcctgccactaatttcctggcctgagatttcaggtgagtcaaaaatttcccatgactccgtttccttaatcagacatgagtgatagtatctgtcctagctttccttcctgggatgctgtgaataatacttgtttttaagtaaaaatattctatacataataaaaatcaacatttgaaacatcatacagataacattcatttgtatatataaccaaatttggataaagaccatgaaatattttgcagggaaataatgcatcacaatggcttattttccataactcataacaatgccatggtatatgtgatacaacagctgagttatgtgaaagtgtaagtagaaattacctaatgtccatgctctgaaccattgcaacagagagttcccatgatgccgagttatgcttctggtattactgcaatataaaatgtgaccatatcacagcctataacaaggtacagtcctttctacaaatactagaggtattctatctgctctctttctttgccaaacctcatatcctttctgccattgacttatttctggaaagcaggtttaaggcaaagaagtaagcaaaataaaagtaaaacatgagaactgaaaatcaaaagtttgcagaaagaacgcatgctgtcttcttgagagccaaactgtaaactacaaacttgttggggcttcctgagcctttctatttcattccttcatttcagggggcctaaaaataaatgcatgaaatagctctttcatgggccccaaggcttccactgccttattcgtggcttcttgcctttcataggaaggcttccagttctggaagtttctcttcatgcaaacagatccacttgaataattcctgagcttggatgagcaaagacaaatttccatatgcaaactcaacaatgaagaactgacagtttcagatggagccagcctgctgttgacctatttcaaaactgcatctgcaaagagggtcaggattccttttcctccacgtattggagagatagcctaggtcttccgagctaggcacttcagagcaattttgctcttcaagacaaaagtatgcttctgttcaccctaatgggatcatgaagacaatcaattaatattcatagagcactaatgcactgactcaccgaacaaacctttgtacacttttggaagtgagaaagggccaaccactgggaacccatttattttaatatctcagagggcctcatataatgataggtatatagtagatgctcagttctttactgaccacctataaaatgctaggcactacaaacacaaagatagctaggtcagagggaccttattcaaaggagaataaaaggcaaacctataaataaataaattgtcatgagaactataattttaaaagtaatggcgaagcacgcacacacacaaaaaagagtcaggatcagtttcataggaggtatttaagaggtatccctaaaactagccttaaaaactaagtattattggtaaaaatgttatttatgacaggaacctcaagtaaaagagaaaactaagaatgggcaaactattgccagtcccactaaagccaagttttccctgatgaattgtctcagagcagtgtttgggaactggaatattaatatactttttcctaatgatggactcacatattacatgcagacagctaagagttatttaatctcccattaagattttggccaaatcctgatttaatttcccgatcgctgtcacaggagcaaacattttcctattttcctcaggaacctgaaggacctcagaccaaaaacaatttaagagatgcctaaagggatggcctcaagttctacaattatctgatatgcagttggcgctccatatcgcaagtcccacaccccaacataaggacggccaactgtacttgacttgagcatctgtggattttgcaatgaggggatgggggttcctagaaccaacacctctcagatacaaagagacaactgtgactgaggaacctactgggagttaggaatcaaatagctccccacccacttccacccccatagtaccctgtacatccccttgctctgctccgttccgcctaccatgcagatccttcaatcaatgacatatcaccagttaaaactcccttccacttcttaggaatggagcattggagaaaattcagttccctcacatatacttgacagaggttacaagttacttaccaaagtcaaaattgtgcctaaaaagctaaaaccacattttttaaaaaagtcaactagaagaggaataccttacttagcattcaagaaccagcattgccactgattttggctaagaccacactagtggtcagctgggtagtaacaaatacagagaaccaaggtctcaagaacatgctgaaaaaattaaggaaatgtacttcgaactcaagagtcctctcctacctgtctagttatagagacaaggcacttgtttagacattatctcccaatctaagaaagcctgtcaaaagctagactcttcatccacatattgtatttccctatattagtcactcctgaattttgttaaataaaaattataggaggccatagttttggactaagttcctgcattagacccaaacaaaccagaccaaaccaaatggaatcacacattctaaaagtccacagaccagtttcaatcggcatgacaataaagttccctctatctttaatccttacaacaaaatgtaacctgatgttagccagttatttttcttctgttctgcttccctgttcccaccttacaaggaaagtaactttgcaatggtcatccactttttccttttttctgctttctttagctcttgtctacaaaatcaatttccccttctcgggtcattggaacactcattctaccttataaaatgaagtgttgcccaattctagaatggcgagtaaaatcaattaagatctttaaactagattttcaattttgtcttttgataatctaaaaggtgatatcctatacaacacaacatatgctactaggatttcctacctaataccagccaggaggtttaataatagattatcataaaaatacaacattccaataagtcctaaaggagagagtgaataatactaagataattagtataagaggcattagcggattgttttcatttcttttttaatccaagaagagttcaaatgagtgtatatttatttcttaggtaaaaaatctctcccattagagggaacacccacacctctgtccttgccatttacttatacctgttgtttcttacataaatcatgagtttaacacattacccgataacctgttaggtgacttttatatcctagaaacatatcttccaccctcttgtcctagcagtctatcctcaattttctttgctgatcttaggattgtacagtactacttacatgctaagaactgaactgacaaatgacaagtgattctggcttctccaggtgaaaaaaaaacaaactgtggaaaagaaaaagacaactagaggccaactgtgaatcatttcagactcttaaaagctaactagaaatcccacacccagtaatccatattaacgcaatgatcagaaatgctccattacaaaccatcatggatattcattatattactacaaattattattattattatttttttttttgagacaggttcttgctgtgttgcccaggctggagtgcagtggtgcagtcatggctcactatagccttgatcttctgggcttgctcaggtgatctcccatctcagcctcgcaagtagctgggactacaggcatgcaccattacacctggctatttttttttttaactttaaggatctcactatgttgcccaggctggtcttgaactcctgggctcaagagatcctcccacctcagcctcccaaaatgccgggattacaggcatgagccactgtgcctggccaatgattacaatttttaaaaggagaaaatatgtgcacctaattttttaaaaggagagaaccaccagcaaactgttaataccatattttaagtgtaagatgcccctgaatgtaagactcaatatgacttgatgttacactaacgagataacacagtcagtaaaactctttttttttttttttttttttttttccgagatggagtatcgctctgtcacccaggctagagtgcagtggcgccatcttggctcactgcaaggtccgcctcccgagttcacgccattctcctgactcagcctcccgagtagctgggactacaagcacccagcaccacgcaagtctaattttttttttgtatttttagtagagatggggtttcaccgtgttagccaggatggtctcgatctcctgacctcatgatccgcccgccttggcctcccaaagtgctgggattacaggagtgagccaccgtgcccggcccagtaaaactcttaatttagcatagattagtagatatattccactttcagagaggttaaaatgtagatcttaaaatatataaaatacaatagtgatataactacaggtgattaattatttatgggcacatgaacatataataagagatttggctaaagataatgtgcacacagaggcaatccagtcaagccggtaatggagagaaatcttaccaaataaattttcctactagtatcactatattttccatttaggtctactaaaaattttcatgaaaaagtattatcagaaaactgtaatacatccttcaccatgctctccagcttattcttttaactttgccctacctctgacagaacaattgttctaccgtcattactacactgctgtagtaatgctgtattggaggaagctatctatcgcctaatttttcctcaattgccacactcaactgtgtgcagtttatagaaccagaaatatttatatacttttggcttttactccctcaaccctatgagatgcacctactacccaactatatgggtaaacttaacccaaaaattactccttttctctggtctgccccaccacataccgccatgatttctctgcatcttcctcctaagcccaaaattaccaatttctccccggaatccatgaaatttgcttctttgtctctcccattagtctgtaacctgtaaagtctgtaaaaagaactgcccttcccccaagacagtaccagtgcctaatatggtgcttaacccaaagtattcaaaatgtttaatgaaatactgaaaataaatcatgaacacaagcacatgaaccagagaacagtaattatataatcataaccacattttgaacgcagttaaatattttcaaaagataaggagtatgtatggtaaaggtctttgaaaatatgaatcaaatttacataagtcccctattgcaaaatctgtaattttatttttattttttttatttatttttttttttgagacagagtgtctctctgttgcccagactggagtgcagtggcgcaatcttggctcactacaacctccatctcccaggttcaagcaattctcctccctcagcctccccagtagctgggattacaggtacccaccaccacgcccagctaatttttgtattttcagtagagacggggtttcaccatgttaggcacgctggtcttgagctcctgacctcaggtgatccgcccgccttggcctcccaaagtactgggattacaggcataagccaccatgcccggccaattatatttcttcaccagattttaaagcaagagcatattcaagtctccgttaatagttttattttacatgtaaaatatctgttttgttaaaatttcttttaattggtgaaaatctcttagggaactataaatttcatacattattttgagaccacttttggctaattggctcctagaatgattgctatgtatgaaaacctaaacaatatatcttattttcgaataattcatttactataatatcactacacttgtttatttctcacacgttccaaacataagaagccatgaaatgtcaccaccataataatataatgcagacactaagccaagatgttttaaatcacatttaaaaggtacacaatacattggcaagtttttttaaaaaatcactacattttctgctttaaatcactcaattttaataaaagaatatacacatacacatatacacacgtgtgtgtgtgtgtgtgcatgtgtgtgtgatgtgatttaatacataaagactggaaagctataaaacaaaacagtgatttcttaccagaagcaaattggggaataaggtgaaatttttacactttgaaaataataaataaatcagtatcattaattataacagggttgagcaaacagacttcacgtggtctaaaccttgtactatatacatatagcacttcttgaataatgtctaaatagtgataaaataataagaatttccacacagagatgcatgtattgtattattttcagccatgaagtaacacttcactcacacacgttatagtcaagtcatccatttcctgaaataaaatttgtatctgtcagtcacatgataaacattttttctattcttttagcactattctatactttcccagaaagattctggttataatacaaaaacatataaccagaaataaggtaatatacaaaaatatatagcttttcctacatggcagcaataactgctttctggaataactattttcaaaatacaacagaacaaagggccccatttataaaagcagcaaaaactcaatgaactcaagaaacacaggttacctataaagttatataactttactgagagatataaaataagacttgaataaataaaaagatataacatgatcttagactgaaatggtacactatcacaaaaaggctaattttctatacctttaacacaattccaacaaacatcctatcctctacaggccaacattaaagcatactaactggcaaacctccagaaaaaagcagctagtaatacatgaaatgatattccacctcacgattttctgaaagattagcgaaagtttttaaataaggtaaggttacactcctacaatgcaaattggtatcacctctttggaagacacgtggcaacaaatgtttccacttattctccaagggccagctcttggttaatatctatgagatttaaactgtcagacagacctactctgcagtattgcatcgttactgtattacagccttatttgctcactctttcagtggatgtctaagcctccatcagcttgtttattctccaaaagcaagggacataaattttattatctttatatcagtacttgttgattaacagaaaattgtgctaggggaatctgggaggaaatgaaaacccacactcatgacattttataataataaaatcaccttaacttcagaaatgttataggaatgcatttgtgattatcaattgttgtgtgttaagataacaaaatgcaattattaatcagactataaaaaatcaattatttatccatgtattcatctatgtttatcacctagaattatggcagagagggcattagctaaataaaaaggtcctaaagctgccgaataaaagttgcgaagcagagctagtttaacatgaaaatattcctcacctcatctttcatttcttctcctggtctgctaaatgtaaggagaaaaaagggtaaaagtgctccttataaagcaatggactctgtttacctttaattctaactatccaaggctaaaatcttgctgctgtctagcaaaatcataggacttttgctactaggatgaaattctatttatgcccaacatatgattaagttatttacaaaataaattaacaaatgcagctagaaacctgcctctggagaagcttatggccactcgtaagagaaaaaacctaacctactttcaaccggagccatgctttcccatgtcaaacgtcagaaaattgttttatactccctaatcagtactattcatcactttcttacaacaagaaagatggccatttccctctattttagaagggtccatctgtaccaataatttagttatcagacaacgtatccacaatccaagtggcacaatttaggaataactaattcttaccaaattaattttaaagcaaccttgtggtatgtgagacatatttatgtcaaaaatcaaggcattagtggtctaagaaaataagggattatttccattgaattctagtagccatagactaaacattcaagatggtaagtaaaagatctgaggaaaaccaaactgaaattatatagtatttgagagagatgaatatcagtaaaactcataactcaaagttcaaagctttattttttttcttcaatggcatagcacctctgttaaagacaagttatattcatatattccaaatgttcaaatcctgcacattaaaaataatcaaaagtacacaaggcaggtaaggttacttacctttttattgtgccttaggtgcaataaattaaataaattaaatctgatacccataaaccaaatcttccttgaaggataagtgcttttgaggtaaagattacagaaacaaattaattaagtcacattaatagagacagaaagtaacaaagtggttgccaggggtcagaaggaggggggaatagggaattactacttaataggtagaaacttccagcttggggtaacaaaaaagctctgaggatggatagtgataatgactgtgcaacaatgtgaatatgcttaatgacactgaactgtacacttaaaaaatggtgaaaatggcaaatctaatgttatatatttttaccacaataaaaaagaaaaaaactaataatcaaactgataatctaaactgaatgaaaaattgaacaatgtgtactcgtagaaaaagattaaaaatttgttagtaattagaagactttaaataaagagtgcgaatcatttccctgattacagactaatgacatcagtaagaatgacaattttctcaacaaatgaagcaaatataatactttaaacttattcttgtaacatgaatagatctccaaaaatagttaaaatttaaaaagcaatatacagaatctgattctttcaaagagcttctgaaagatttgctctcctgaaatgaaatttggtaagggaggctccaattcactgaaaagtggttaatgtaaaggaacaaatgccccgttttccatgaaagaaattgtactgccagataaggctgtaaaacttaaagatcagataaatggtgagtggacactgctgatccagatttagacagaaaggcattcttgaaaagactcaccatgtgaatgcccagccagcctctgtaataaaattcaaaggcagcaaggcaagcaaagcactttggcaaaaagtgtttcaactactcagcacaaaagaggtatttcattttatctgtcttcttggggggaagatagacatatttttagacagtatctaagtgtcagaaagattccaagacattaataccatttatgaacaaagagaagtaacaaagtgaacactattccacaaagtatattaaacaaattccttgtttctcctggcttaacaagggagagcgggtggaagggtagagaggtaggggactggcatgtcaatggaatagaaagaatattggaaaaataaatttcgtaaaattctttcaatgaattggttcctgagtcagataggttttttatatctacagaggcaggcctatgtaaatatcctataaacaatgtcattagaaggtctaacaccttttcaaagatcttggcatcttaaaggtgaagatttatattctctttcttggcaggtctctaatatgtctaacaaaatcattaaagggagatttagtcagatttgttgatcaggaaaacatccacagatggtaagagaaactgtgggtgattatcaccttgctattgtctttggccagtaggttcaatatttagggctgccaccctgaagacgttaacagaacccttctatctgctggagcaattggctaactttatactcagccatcacaatagctgtacttacaacctatcttcaaatacaagatacagaagacatggctaagagtacctaaaattccaacatatcctgaaaaagcacaatgcaaaacaactcagggtctgtgctccaatgacagtaagtctgtcgtagcagcttcctatataaacggcaagctattttattttgtgatttgatgacaatcaaacctaggggaaaagttaaagggaaactacatgttgtaattaattttccaagcaggtgccagagataccaaatcaaactcctgtaatactttttctgagtcagggaaagaaaatgaaaaaaataaggagagaaattacattcaagctaacaaccaatggcaagtactcaaataaatacatggcaaactgtaaggtgctaaggatacaaaaaggaatacatggtacccaccttcaaggaatttactctgtgctcctctgataaagatgtgatttctttcatcactgccagtcacctccatgactgctcttcaccatcactgattaagtaccatgacaggcagaattctaaagctgccccccaaagattcctgtcctctggctatttaaccaaacactaatctaggtactattgtgaagggattctgcaaatataagtttactaatcaactgaccataggatatgaagattatccagatggtcctaatctaaccacatgagactttaaaagtgaagaactttcttcagctacagtcagagagatggcgtacaagagagaagtcagagagattctagcatgagaagaatttgtcacgccattgctggctttgaaatgttaagggcccacattcaaggactggagagatgcctctagttgctgagggatggcccagctaacagttggcaaagaaacagagacctcagccccacagccacaaggaaccagattctgccaacaacctgaatgaacctgggagcagattcttcccagagcccagctggcaacacctagatttcagcctcaggaaacccacagcagagaaacaagttggggcagtcccagcttctgacccagagaatcatgagacagtctcgttttaagccactaaatttgtgttaatttgctatagcagcaacagaaaattaatgcgagaacttaccatatgcaagtatttggacacaggaacccatttaattctcacaacaaccctgaaaagttatcatcctccattttacacatgaggaaactaaggaatagagagttttaaataatctgcttaagaacacagaatctaggatctagtaatgactagagtggtttactgtatattcaagaaaactaattggcccataatggttataatatgaattaaaaattgcagctggaatttgactaaatttcactcaacagggaaatactttcattttaaagatcagaaaactttaaatggtttaaaatgaaaaggttctctaaatcagaggggtacttttttataatgtccttaagtgacgttaatatatcatataacgtccttaagtcaacccaacaggaaaaacaatattactaaaaataaattcaaacctatgtaactatgtacttcttcctgcatactcaaaaatcaagagcaatactttgtcaatcaaaggctacgttttaacattaatttttttaattcttatccacaaaaccattttaaatatggtattatatgaagaaaaaaatgaaagtaatttttaaaaaccatgtgagagagttttttcaagaaagagaaaaatgaggaactatatacagtaccacactatttagaggagatacatccctgctcaagaaagcagaaaaatccagataaacgcaataatatagaaagacatcaggggcaaaatacaaaccaaaaatgaaatctaatatttattttatgaggaagataaacagccagtcaatcacatgcaatggctatagaagatgaataaatggcatttcctactcctcaaagagttactgctaaagatagtaaaaatttaaaaagaatttgagtttctgttaagagagactcagtcaaaactcaagtgagaaatcaacaacagttatattccaaaacagtaagtgtcaaaaagtacaaatgggagaaataatatttggggagatgatctttaaataaccacatatacacctggagctttattcatcagtagcactttcttctactgctgatgttttcttgtgtgacttttcaccatgaattgttgactttcagagcatagtacaaagaaagattggggaacacagaagatcgtgcactgaggaatagcatgatatggaatatggagtttcttctcaaataaaccaaccctggaattccaaccagtaatgtgaatgtatgttattaaatgaacacctatttgtgttttgtgtacagatactgtactcatgtcactcttaggttcagtaataaaacatttattaacctatttagaaaaaaagagatgatttctagcctaataaatttaaaagcttaaatctaaccatagctaatattttctgtactaatgtcctatttttaaaacctccatctttgtcattattaattatgcatatggattgatatcatttatttgcaggtgttcctaaagtaaattgcatatatctatttagattttttcaaaggctgatagcatactagttgtaacttagaaaatgaaggtaccaagatcctttttaacctgtaaactctgcaaaactgaatgggctagaaaaagaacttacagatagttttggtcatatcctagttcttaggttggatggtcatttcaaggatgttcattttattattttgttttacagtttatactttacatgcatttatatgttccaagtgttacagtttaaaatgaactcaagaggcgatataatttcttgaaaatatagttataaacataaaaataaaatcatgaaaacatcacttcattacttcccacacacattaattctacctaattaaatttcccacatatattaagatatatattaatgtgctagatttaatagaaaaaaatcatttatataagagcacaaaatagttactcaagagaaattagcacctgcttcaaaactaaaatctctaaactaaatatctaagcaaaagaattcgcctgaaaactaaaatctctaacttaaatatccattaatatgctaaactaagaattttagtaagtacatagaaaatatagcttatagatctgatcttgaaaaactttttctctgtctataaatttaatgccataacactctccagcaactaaaatgctgcaggctaaatagaagtttagagttgtttaggatagattcatgacctatccaattgattgtcttacctttaaatattggccaagaatgaatgtcacaagtcagtttacagactgaattgtgcacccgtttccatttttttttctactataggtattattcccatttccaatttgtttttctatttgcctaatggatcatgcctacttcaatattttgcagtaaagaaagctcagaggattaggagttaaacattataaactttttcttattattagaaactttatcttcaagtgtcttcctactcttgttattagaaaaacattgtttaaagacattcgccacataaacaactcatatttctccaaaaagcatcctacctatcctatagtaatttatcaaaaaataagtttccagccttttcaacaggtgtttaaaatatgttaaagatagaaccaggttaatctgacctatccaactccagcttagcttttaacaccctgaaataacatccttatcttttaacactcaggaagggttagtatttctttataaatagttcctcaacttcacagacaagtctttaaggaaaggtttcctataagaatgtaaatttaagttctggcaagctatcttaaagaaaaaatcttgaccacagaaaagcattacacatagatgctcattagtattatttgtcataggaagataaagaatccacttaaatatccaacaagtaaaaattattacctaaatggcattcctcttataaatataatgagacatcaaaaacaatgttcaccccaaaacatgtataattacatgagaaataccttatgttaaagaaactatgaaaaataggataattacaattctaaaaaactgaaaaatactataaagtatgttaagtttttcacattattgtctttctgcaaatggtacacaatagacatgcataattttttaaatctgtaacaccatagttattttcctactactcattctttaaaatatgctggtaccacaaccattttaacacctagtccccatgaagcacatacctccttcctcacttttctggaacgcacatttccaacatactcaaccatctgaaatgcagatgaaaaattctcagatagaaactaacaatagacttgtcttcaggaagatgcaatcagttcctaagttttcatttattatcctggataacaaagtcaagctgaaaactattaaaatatctttgtcaaaaatatatttgactatccacaatcattacagcatataaacacactttggcttccatgattcctaggaattcttttatcagcctgtgtcaggatcctaaggaattttcacagttgctaaatgacttctgtggtccatcatatcactctaccgagagacatagccatttggctacagcttttaccattcttcaggggagaagaggtttatgcacaaatccagaaagctttaaagatgctgatttgctctgttttgtttttaatcatcaatttcactataaagggtcaacttaaaattaagaaataatggtttaagaaataagcaaataattctttgaagtatttgaatttatctctgggaatattttttcctaacctcaaagtcatactgcaatgatatttcccaaatataatctaattgcctgaagttttctttaaaaatattcaaaacctatctattttaacagcacgtgatggcattttaccagtgttttcaggctgccactttaaaaggtaaaacaaagtggtgacagctaaaaagtcttttcaaattaattccccattttcatccttgaaacagacaaatttccctaccacggacattttctcaatattggaatgctgttcaaaattactcaaggtggtcctgagtttgttatttgaatacccacgagcaattcatttaatttcatatatattaaaactgaaaaaacaactgttttattaattttacaggtaccaaatggatcttcccaagggaaaggagtaagcccatagttgtactatacatatatgcaagatgattttttttcctcctagggtaatttgcatctggatgagaggttggcttttaaattggcccactttcataaattaaaaaatgtaatacatttacagctagctgaataggaaatttctgtacttcattcctgccaaactacaagcaagctacttaattaatgggagtctgccattatctttttgccctcaagagaagaactaggcctatataaatcatttttctctctgtccatcatacttactgtaaaaagtttaataatatgggcaaccatacccagaattacactcagaaaacctactcccttgcttctcagcgtgctctgcaaatcagtgacatcagtatcccctgggagcttgttggaactacaaaatctcagactccccactgcgacctactgaatcacaatttgcatttaacaagatgcccaggttatcagtctgcacattaaagtttgagaagcactagtctagaggttaaggtagaaggcagaatgatatactatctcctgcttgcacgttctaagttgtagaaagctgcaaaaaatctacagtcagcaatgaataaatcattcctagagattactggtaaatctttaattaaatgtggcctttccacatagatttagaaaacgtgtgtggctgatgctcagtgcctattaacagcgttttcattacacaaccggaactagattttttaataacatactgaaaataggtatatctgttcaccattctctattaacaaagcattcttactaaagaattgtcctctttttcaagcctaagatgggtcttgtggatgaaatctatttttagttgctccaagttaaaaaatgttttaaagaaccttaatgtaagaatcctaattgaccaatttgaggaagcatttacttcacaaattaatttaaatatgcttgagacaaatacataacccctatcataggccctcggctcacagtagacagtcaatgttatacctgtaacaaagggtcctcataatttcaagaaggattttcataagacaataccaaataacaggctcctggaaatttataacacagtttgagtcacaaaagtacaatttgcagaactttccataggtttgcccaatatgcaacatgtcacacttgtactgacctgtgcttagtccacagaatttttaacaagatgctttctataaggatttcaactgtaacctaccacaaaagtgctctgggaataactttatccctctacaatcattgccttgttctaaacagagccctaaagtaaattaaatctttagaaaaacacacttttttgtttgtaaagaaagaaacatttcctgaatgctacagaatgtttccttgagaaactgtttatgttactgtgttgaaaaggtgtttatgttgctataaacaccttccatgtaacaggggatgcagtctccccattgtttatattgtaatcagccctgtttctggaaagatctaggcttataattcatgcctggactaaccttcactccattctatcccaattagatcactccaaattatattctatatttgtttagcataattgacacgtcacatgagtacaggggaggttaggttcataacacgcactgtaaaaacacacacacacattaaaaaaaataagcactacaattacaaagctcattaattagcaggatgttgtggtttgtgctgtgttagcctggttaagctgaaactacttttcctaggatcttccagtatggttctaggttaaagttgacatggaaccagaaagtagaatttgcacagatttggaagccaaaaatcgtcatggttactatattgacagtccactatgccagtggattcaggcttatctttgctcttctcaaatccctgtccaacttcctctacagataaacagtgctttaggcccaacatacctatacagatgataggtacactgaggcacagcttctcagagacacttccccaagagcctttctcagactaagtggggacaccactgatcctccaacttccctcttggactttcacttgtcaagcttccactataaatgcttaagatttaatttctataataaattccttatgctaataactcattggagttcttcttccgtgatcaaaccacaactgattctcaaaacggtttacttgttggctctagatttaaatggtttcttgtcattaaagacatgctgtagtatccagtagtaaatggcaacgcaaacttcaccttctgatattcagttgacagacagtagaatatggcctggggtctaaacccctctgacctcccaaaccttcatttttttctataacttttcaatgttctttttgctctatctttattaaccacaattgacattaaaaatcacatatttaaagtaatacaatttgatatgttttgacataaatatatacccaggaaaccatcaccatagtcaagataaggaacatccatcaacccctaaaagttttccccgaccttcatgatcctttcccctccctgccctgtctaggctccattttcaggtaaccactgatccacttcctgttcttataattatgctgcattttatagaattttgtatacatggaatcatacaatgtgtatgctttttcaggggttggcatctttcactaaatgtaattatttaaattactttgagaatcacccatggtgttgggtatcaatagttcattcctctttattgctgagtagtgttttatgatgtggaatttccacaatttgtttatccattccctgttggtggacatctgggtgtccttcagtttgggccaattacaaaaaaaagttcttatgaacttgtataagtgtgtaagtctttgtatggatatatactttcaattctcttgggtaaatacctacaagcagaatgattgggtaggtatgtccttaatgttttatgaaaattttttaaaaactgtttccaaagtgattataccattttaagtgtccatcagctaggtaaaagaactcttctatgggtgcagtggctcatgcttgtaatgccaacactttgggacagtgaggcgagtggatcacttgaggccaggagttcgagatcagtctgcctaacatggtgaaactttgtctctactaaaaaatataaaaattagctgggcgtggtggcatgcacctgtagtcccagcaactcaggaggctgacgcagagaatcacttgaacctgggaggtggaggcagaggctgcagtgagcagagatggcgccactgtactccagcctaggtgacagagcgagacgctgtctcaaaaaaaaaaaaaaaaaaaaaaaaaaaaaaaaaaaaaaagttcttctagctgttctacctttaccagtacttggtgtggtcagtcttttaaattttagccattctactgagaatgtaatactcttctattggttttaatttgcattttcctaatcacttatgatgtcgagtatcttttcttgtgcttctttcacatctgtatatctcctttgatgaagtgtctattcaaatcttttgcccattttataactgaaccatcttattattcagctgtaggttattcatataatctagatcaagcttgtccaacccgccgaccacaggccacatgcagcccaagatggctttcaatgcggcccaacacaaatttgtaaactttcttaaaacattatgagatttttttgtgtgtgatttgtattttttttagctcatcagctatcagtagtgtatttcatgtggggcccaagacaattcttcttccaatgtggcccaaagaagccaaaagattggacacccctgatctggattcatgcccttgtcagacatatgttaacaaatattttctcccaggctgtggcttaacttttgtaacttttgaagagcaaattgtttttattgtttcaatataactttaagcactaaagcatactgccttagtattagtgtattagattcctagggctattgtaacaaaataccacaaatagggtggcttgaaacaacaggaatttaaccattcatgctagaattctgaaatcaaagtgtcagtagggccatattccctctgaaagctctagaaaagaatccttccttgactctcctagcttctggaggttgctggcaatctttgaaatgcatttcttagttgtagcagcataactccaatctctgtctccatcttcccatgggcttcttcctgcctctgtatcttcatataaagtatctcctcataaagacagcagtcactggacttgggccaacagtaatccatgatgacctcatcctaaattgatcacatctacaaaagacactatttccaaataaggtcacattcaaaggtacctggggttaggattcaacatatatttgggaggatataactcagcccataacaggcatttagtgtttaatatgtttttaaaacccactgtaaatgatacagggaggctatgcatgtgtgaggggagagggtacacaggatatttctacatcttcctctcaattttgctgtgaacttcaaactgctctaaaaacattgtctttaaaaaaaacacacactgaacaataaattatttgacataagctctgacctccttgaaacagtccatttttgctgcaataactgttctcatagagataccttcgaaatcatttgcagaatttacccatggtcttatttccccaaaatagatgcattccttgcaatacaatcagctcagcttaagggtctaccctgagctgtccccttattaacaactgttaggtaaaggtacatgaagaaaaaaacttgtatgactgtttcttttaagatctctattgttctgtctccaaatagggtgtaaaaatgtagcatcctcctgtagtcccagctactcagaaggctgaggcgagaggattatttgagcctagggctttgaatccagcctggacatcatagcaagaacctgtctcttaaaaaaaaatgtgggggaacaggtgttaatgcagtgacaactctaaatctgcattcagagatgcctcttattccatccctgtcttccttcaataccacctaacagaaaatggaaaaatgcttctccaaagaaacatgttccaattatctattgatacataataagtcaccatcaagcttagtttaaaacagtaatagccattttactttctctgagggtcaggaactcagaaaggtttgattgtgtggttctagctcagagtttctcatttggctgcactgaaatggtgcctgaagcaagagcggtgcagggctagcagggcaaaggtctggctgcttaatacagttggtcttctcagggcccttggtctctcctcacaacacaatggcctctgagcagctggactgcttacatgaaggctgcaggtttcacaactgaacaccgtatttcaacaaagaaaggagcatcaccttttctgatctagcttcagaaatcacatagcatcatttctgcactactctattggctgaaacaggcacaaaagccaacctagcttcaaaaagaaaagacaaagaccctacctctcaaagacagaagtagcaaaatcaactgtgagaagagcatgtgggtgaaagataactttacggaaatctttggaaaattcaatttgccccagaatatatcctagttctccctggggcatcaagaactattgaccactcagttcaaattaaattctaaggcaaagctatacactgacatgcccaggctcaatattttccccattcttatttctcccaatactgttttccatcttgtctactacagttgagtataccctattgactttggtcctccaggtgttctgtgttacaaaaaccgaattcagaagttacttaccacaggtcatatagagaaactaatagcaatctcttgatgcacagctgcatcattttcaactccctccagttcaatgtcttctttaagttcaatgcccagaaacctgggttacactctagccctcccaataattattaagaattgcctataattcagagtttcaaatcattctttcattagtttaaagtgaatttcccattataaaacacacagatacacacacacatgcacacacatgtgcaccactttccttagctaaatatgattgatttttggataatttaccaattatggttcatggtatccattcactagttaaaatgcctaggaattactatatttccctttctacttccataaatcatgatgtcacaaatctttattcaaatataccatttctaggacacctcatttactttaagattctctcattctccataaaatgtaatggaaaataaattccacacaataaatattgatggaacactgaatacataccaggccttctgctatgtgtgaggtgacgaaggcaaataagacagtttccttcccctcacatagttaaggcatctaactatgaagacaaatttaccaacaaccatgattattacttacaatatccaaaggagccctcattaagacctaggagactcagttaaaaccacacccggccgggcacggtggctcacgcctgtaatcccagcattttgggaggtcgaggcgggtggatcatgaggtcaggagatcgagaccatcctggctaacaaggtgaaaccccgtctctactaaaaatacaaaaaattagccgggcgcggtggcgggcgcctgcagtcccagctacttgggaggctgaggcaggagaatggcgtgaacccgggaagcggagcttgccgtgagccgagattgcgccactgcagtccgcagtccggcctgggcgacagagcgagactccgtctcaaaaaaaaaaaaaaaaaaaaaaaaaaaaaccgcacccaagaggtcaggcgaggtggctcagacctgtaatcccagcattttgagaagccaaagcaggcagatcacctgagaccaggagttcgagactagcctggccaatatggtgaaacctcgtctctactaaaaatacaaaaattagctgggggtggtgacacacacctgtaatcccagctactggggaggctaaggcaggagattcacttgaacatgggaggcggaggttgcagtaagccaatatggtgccattgcactccagcctgggcaacaagagcgaaactccatctcaaaaaaaaaaaagggggggggggggactaccttttaaggaaaagtaggtaaatatctgacaataataaaacgaagagtactgattgttgacaaagttaaaatgtaagcaaaaattccagagtatacagaatgcctggcttgacagggcaccacaaatgaacctgacttgaagtgtggttccaggtgcctaccttgttagcctcatgaccagccacaaagagccatatttgtgtctgatcatgagactaacaaggtaggcaaatgccagcctgtgatgttccttacatagcactgtaaggagctgaattctacaggtaatagctagccaccaagtatttttaagaggtgaaaaaacttgcagacaacgtgatcttatacagttgcttgtctatatccatgggttccacatctgtggattcaaccaaccacagattgaaatattaggagaaaaaattacatctgtactgaacttttttattgtcattattccctaagcaatacagtataccaactatttatataacatttacaatgtattagttattataagtaatctagagataatgtgtagtatacaggagaatgtgcataggttatatgcaaatactatgctattttatatcagagatttcagaatccatgggtttgggtatccacaggaggtcctggaaccaatcccctgcagatactgaggaatgactgtagacaaacaaccctaacatctccatcaaaaaactgttagaactaataaataaattcagtgaagctgcaggaaacaaaatcaacatcatttttcaaacatcagtagcatctgtatatgctaacaatgagctatctgaaagataaattaagaaaacaatccattcactacagcaaccaaaaagaacagaatgcttaggaaaaaatttaaaccaagaagttgaaagacctgtacaccagaaactataaaagattgatgaaaaaaactgaagacaacacaaataagtggaaagacatactgtgttcacaagtggagaaattaatagtgttaaaatgtccacactacccaaagtgatctacagattccccaatcaaaatttcaatgacattttttacagaaatagaaaaaacaatcctaaaatttgtatggaaccacgaaagaccccaaatatctgaagtaatctcaagcaaaaagaacaaagctagaggcatcacactatctaacttcaaagtatactaccaagctacagtaatcaatacagcatgctgctggtataaaaagagacacacagatcaatggaatggaatagagggcccagaaataaatctacacatatacagtcaattgattttcaacaaaggtgccaagaatgcacaatggggaaagcacagcctcttcaataaatggtgttaggaaaactggacaccacacacataagaatgaaattcgacccttacttcatactaaatataaaaatcaactcaaaatggactaaagattcaaatgtaaaccttgaaaccataaaaatactagaagaaaacatagcagaaattctccatgacattattctgggtgatgattctttggatatgaccccaaaagcacaggcaaccaaaaacaaaaacaaaaaaatagataactgggattacatcaaactaaagagctctgcacagcaaagaaaacaatcaacacactgaaagacaacctgcagcctggaaaaaaatatatgcaaaccatgcatctgataaaagactaatatccaaaatatatgaggaactcaaacaactcaatagcaagaaaataaataacctgattttaaaatgggtgaaggacttgaaaagacatttctcaaaagacgacatacaaataggcaacaggtgtatgaaaaaatgcccaacattactaatcatcagagacatgcaaattaataccacaatgagatatcacttcacacgtgctagaatggctattatcgaaaagatgaagatagatttttgcaaggatatagagagcagagaaaaaggatccactgtatactgttggtgggaatgaaaactagtatagccattatggaaaattttaaggttcctcaaaaattaaattattgacctagcaattccaaaactgtgtatacatccaaaggaaacaaaaccagtatttcaaaaagatatctgtacttccattttcactgcagtactagttacaatagtcaagatatggaatcaacctaagtgtccatgaagagaagaatggacaaagaaaatgtgaaatatatatccccaatggaattgtgtgtgtgtgtgtgtgtgtgtacaaatataattatattaaaggctgaatactattcagcctttaaaaagaaggaaatcctgtcattttcaacaacatgaatgaacctggaagacattatgttaagagaaataggccagacacagaaagacaaataatcacatgatttcatgtgtatgtgtaatctaaaaaagctgaactcattgaatcaaagagtagaatggtggtgggtgggggcaggtggagagttggggagatgttgttcaaaggatataaaatttcacttgataagaggaataagttcaagagatttattgtacaatatggtgactacagttcataacaatgtattttattttgaaaaacattaaggggattttaagtcttctcaccacaaaacatgatgagtacctgagataatgcatatgttaattagctcaatttggccatttcacaatgtatacagatttccacatcatgttatacactataaatatgtataatttttatttttcaatttaaaaaattatttttttaagtagaaaaacttgatgagacccatgttttcagaaaggtatttgtccacaatgagaaaaatggtttgacggaaaggagcccaaaagtaggaaaaattactaagttcaggtgaaaaaaaagaagggctcaccataagtcaaaagacatgaagtgaacaaaacagatgcaagaacatccaatttagtgactgatggcttgaaccagaacagggggtggttgctggtggggtgttggtggtaatcaaagcatcctgtcaaaatgagaatctacagaagttggtgagatgcatgtgtcaaagtcaaatagatcaaaagctaagagaggaaataaaccaagatgacagtgattttaaactcactttctgcaagaagcttggttaattttaaaacatcatccataaatggcatactaagtgacagaatatgacctcaacacataatcacaaatttaaatagtaagacttttcatcatggtgatcaccttatttgctaaattataaacttttttttcctccaacaaaattggaatgtagaaaccagagtgcctgagatgtcagagaacaagaaactttaaaaacaaagtcataaaaatgaataacagaataaaaatggaatctgtacaaagtacacatatgtaacagcaaaaataacaagtgggcagaggataagaattcgaagaggttagcctataagttctaaaataaaaactcttctatttcagtaattcctcattcatccttaccttggcttatggcattgtttcctatgcctcacttgaagatgtctgaaaggactatcgtgacacacatttgtcctgttacaaagaagtgggcttgattgctccaacagttggtaggtttttcctcgtcctctatgcctgtattgcgtcacctcggaaggcttatgttacaggtaagcagtaggccaggcatgtaacattagaatatatccaagcattaactgttcatactaccactagtttagataccccctcagtgtgatcccagctcagccatttttcagctgttgttacgtgagctaaaatgtccttcatggtccaactttacattcccaaagatggtacagaaaacatgcatttctgtcttgctatgtctgaaaaacaagggatagttggtcactgacagtagtcactgtttaaaagtcaccagccctgctctttctttttttctctctttttttttttgagatgtagtctccagtgcagtggcacgatttcggctcactgcaacctctgcctcccaggttcaagcaattctcctgtctcagtcccccaagtagttgggattacaggtgcacaccaccacgcccagctagtttgagacgaggtttctccatgttggccaggctggtcttgaacttctgagctcaggagatccgcccacctcagcctcccgaagtgctgggattacaggcgtgagccaccgtgcccggcccctgctttttcaagagaactggctgatgagcttcctgggaccactggttagactgctggctctccctttcctctgcagcctctccatcctgaatacaattccagagccataaccgtcaagtaaatgctttttttttttaaccttttaaatattaaacaactatacaaagccagtcttcagtgaaacatgctgttagtataaggatacagatttctggcgttgactcatttccagttattatgcattccaaatcacatgccaaaattttaatgaactttcaaatttacatttatgaaaacagaccttggcacacataaataggttatttttccatatcacttttcaaaaggtgcctcatagctaaaatgattctgagctgtcttctgtcattcaagatgaactctacaaaagaacttagtgttcttacttttacactaatttattctacattcattttagtcagcatatggcaagcatatgggaaagagaagtgtatctggaagctgttagaactgcatgtaatcaaaatctaccagtagaaacctaatttgattaattgaaaattaaagtagtagttaatcacttgctatttaagtagggggtgggtatcacttaaaaacgaatctttctcaaacatgtaaaattaattctctttgttccaaatcaacacttactattcaattggcagtatgaagagtgcaaggcaccccctaaaacctttaacaagtaggccctggcttaatgcgaaagtgagtagtaaattttcaagacggtgtctacatttgaaagagaactgtttcttaaaacatcactttagcagttaattgacctttaaaagaagggaaaggggactagctgaatccagatcaagttccaccgatatctacctcttaagttttgaagcttacaaacaatctacaaattcatataatctgttaattgagcatctttcggcaatctacttcttacttacaaggcaccaaaagaaaatcagtgtctggggaagagctaaggaaatatttctgaagcctaaaattgcctcccccaagttgactgcagcctaggctcaaaacttccttcatttttttaaaatgagaatgttaaccctacaaaaacgtattcataaaaaggtcctagtttatataacatttcttaaagcttgcctttaaaaaagagacccttataggtttcctcctttcttcccaaatctttggtctaacaaagtaatcaaaaccaaaattaatctcatgttcaaagccagcagatgatttctcaagattacccaatttcttcctgcccatgcatgcaagaatttgcttattaacttcctcaaagatagagcagcaatattagaagaaaattaaccaatcacaaaatgtcatgtagtctattcccaaaatggaaaaaaaaaaaaaaaaacaaatctcaagcccagaaaaatagataaatcaattggctcaacattttaatgttaaaatcataatagaataaaaggaaaaggaaaggtactcttcacaataagaatctataacaatccaaataaagtatgcctaaaatcatgattagacatcaaaatataacacatttgtttaaaaaaagaataaaagcagtttacatgaggggagaggtagccataataaatctggaaattaattcaataacattaagatattcaaatgtatattccctgctgcttaatccaaaaggagaggttctatttcaatgcatcacaataaaatagtttagcatctgtctcctactaaccagaatcacagattttgaaactgctctaaatttaaaatactgcaactttcccatcataatgttcttatttatggtctcacaaaactgcaggtaaatgaaaaacctacagaacacttgaaacaagtaaggatgacaacagatccattcccttacctctcaccccacattccgcccttccccttttataaagaaaaatgtcttcagtcctatcagtttcctttcacaaacactctgcatcatgtatcctcaggaggcccatccactaaaaggagaatgaaagtgtttacagatggtagaaagagataggagaggacactaccgcagtgccaacactatcatcccaggatctagagacctaaagcagaagaaattctagtcaacaaaaccccagtcataactgtagggaggaactgaaagtaaatcttagaggtaaagaatgaagaagacaaaagattaaaaattcaggcacaagaaatgatttagatgggtaagaacaaaccactgctttacaaagtcagacttcatacaattcaagtagactagcctcgtaaattaaagaaacttaacagaacaaaaagtaataaattcataaaaaaaagttttaaacccaaacggctaaaaagatttgacatgttcactaatggaagtataaaataagtatctataaaccccataggtccagcaaaaacaaaatatggctaagcatccccattttacaatactgaaaaacatttccattttatggtatcactaattcatatggctgtcgtctctacatcctcaaggaactcataaccaaaagaatatggtatatgatttcattttaaataatttcatttttaaagtctggtgattgtgtgtttggaaaggggtggtgaagacatgacaaggaattacaggtcaatgtacatcagtgggaatcagaagcacaaggtctctgttcttttcatgcaagagaggtatctattgtcctaggcttcatattgcatatgatgtatgtacaatgcccacaaccgtttacattccatgaagatctaatgaactccagttctgagtgggttcttcaaactctctccattcagagtccagactgggtacccagaacatctggtagcacaaatcactgaagtctaccaaagatggcaatctttttgttttatggtggattccttttttttaagtatgttcaccatggacagtatactcattaaaatatgtactgaaaggtatatttattctgttcaaagttcagctgaaatgtagtgggggaaaagcttttactgtttctttataattctttgactctagataaaaatggttctcactctttagttgtgcttgtagtggctttaagtcattgaaacacccaggcattgagtaagaggtggcccttttgaatttgttgaagatgtgtttctcttctaccttggtctttctcctaagcattaatatctacaacacttgaggttttggcttttgtttaagcataaataattgaaatactgtatgataccatgttaaaaataagccaccacgccaagactgtattaatagcacagttcaagtcactgctgtaacgtacatggcactgcatctttcactaacaaacgaaatgtaacctgaactttgtcttacacatagccttgaaaacagatatttcattactaccacatatttttgttttatatcctgccaaatgattaactaagttttattgtaaaagaactgtcaatcagagcacagtataatgatcagggtacaattattatttttttttttttacatctgatatccaccacttacaaacttaggcaggccagttggcttcctggaagctcaggttcttcataaagatgagaatatcaacattaccttagctgaattatgtgaatcaaatgtgaaaatgttttataaaccctaaaattctatttttaaaaccatgaaggaaagactgacaggctatattagataaatattaaatatttctgcttggcgaaagagcaaggcaccaccactatcaaatgataaactagaagaaaatatgtgtaacacatctgaaaaagagttaatgtctttaaagaattccaacaacttgataagcaaaaagaatccaagaaggaaaaaaatgagcaatgaataggagaaatgtgaataaacttaaaatatgcgaaaaggtactcaaccttactggttggcagagatacacaaataaaagatcaattttgccgccaggcgcggtggctcacacctgtaatcccagcactttgggaggccaaggtgggcagatcacgaggtcaggagttcaagagcagcctggccaacatggtgaaacctcatctctattaaaaatacacaaaattagccaggtgtggtggagtgcacctctaatcccagctactcaggaggctgaggcaggagaatcgcttgaacccaggaggcagaggttgcagtgagccaagatcatatgactgcactccagcctgggcgacagatcaagactccatctcagaaaaaaaaaaaaaaaaaaaagatccattttgcaaaaacttggtgattgttaatattcagagttggtagtactataaggaaatgtacattttcatacattacttgggagaggggtttgaaagtttctacaatcttccagaaagcatttggtaaaatgttattatttaaattttttaaattatacatcctttagtctaggaatcccactttcagtgtttattcaactgaactaaagcaccagcatttaaagatatgtactcaagaatgctttgccattactgcttaaaagaacaaaaattggaaatgtggttgccatcaataccagaaaggctaaataaatcacatttggttctctctatagaatattatgcagccattaaaaataatgaattatatatctgcatctattaacctcaaaataagtccaagatatgtttaagtgaaaaattaaagtcagagaataatcatgtgactggtattatttaatattataaaatttaaaacaaattaaaacattttaaacatgtctattagagcctaatactagagtggtggtgtatgtgtgtgtgcatgttcatatggaaggatgcttattaatttctggggtgactgagttataaaacttaaacgtattacttttgtaatttaaaaaaaacttcaagaaaaaaataaataattaagaacaaatgaaactgatcagacccagtattggaaagaatatatgcaaatacaaacatatgcaaataataaaaaattgcaattgcaataccttttcttcaaacacaaaaaaattaatctaccaagaaattttaagtataacacaatgagttacaagctggaatctttacagtacaattccttctctcaaactattaccagaagtaaaagcaacagtgaattacattataagatggtagaaaaggcgttatgctatgaagcatcattaaatgtatcacatacattgggaggctgaggcaggaggacagctagagcccaggatttcatggcctatgacagagcctatgaatagccactgtactccagcctcacaacatagtccctaagaaaatatgtaagatttttttttaaatgcatcacatacagatacacagacatcacagatacacatacatacatacatatgcgcacacacatgcacacacacacacctctgcctctccttcctcttcagcaagtaaagcttagaagaggaacacctataagtgctcatactgaaggcagagaagggcaacagtagccacagcagacattaataatctatcacagcactcttctctgtggagcagagagcagcctcagaattgcattaccagtacagagttctaaaatagaagaagcccatccctgagtaggagaggcataaagcctagttgaccttgctggagcaataaaaagaaaaaagcccccaagtctgagctgaagatgagacacagacctcttcatgcacttaacctagcactacaagagcaagctttcaaaagtattcctttaataaatactaacctaaaatactcattcttgatatgcctccaagaaaggctgcaatggtgctgttttacggactgtggaacaacagatgtctccctatctggctcctgatctgaaattccattagcaatcatattttcactccacagtagatttttcttagatgtttaatacagcaacagcatgccaccatgaatcagcaatatcagatgcccgcccactttgataggttggtatgttctcctaaccttaaaacagtggctctcaaactgtgactccagaactattagcaccacctgggaacctttggaagtgcaaattctcaggccccaccccaaatttaatgaatcagaaactttgggggaagagtctagcttgttctgattctgataatggctattgttgcagaaccactgcccctaactatacattataaacagcatctatgagtacaagtgtttttatcctatacaccccctaagtttaatagttaaaaatgctgtttcactagcatgccatgttatgtcattaagcaaagttcatttattgtttttggttttttaatgcagctgattttattttcaagaaactttgttcccagaagtcagtaactgaagttactaaaatagctatgaccatcaccacaactgcttctaactatactgccacaaagcacagtacatgactaaacgcatctccacactaagcatgcagtttgcagagcctgtcttttggttagaactcctgtttatggcattgcccattttgcaacacaagctataaagtgactaagtaaataatacatacatactccacggtataggacaattcaatacaaatgatcaaacatccactacacataagacaccatattaagaactgtaagtgaggctctgttatatttctctacaatttggttttgggggtatctctctggagagtagccataaattctagtcttgccctgatagggctctaggaaatatagttgtagatatttacagtgtacctttcatgagatccttcttcatcctggcagacagcctaatgcctaagtgtctgacctgtgaccaggtgtccctctcacaggaaactggtttatactggcaggtacccttgtggcccttgtctgacctgtgtccagtttattcctcccaagatagccactctctgggagagctctgactaagaggaaaattaggtctgggtctgtcagtccgatgagacacagaggaggaaatacaacacaaacatgtgaaataccagaagcaacgtacgacaaattggtgagaggaggagtaccaatgcgggcgaaagacaagatggcagggaaatgcactcaaccagcagatgggcagccagagagaaatgagctatgggccaaggcctttattggggtccagggaactaaccaagcaggtttcctgtgggaagttctagttggtgggtttagagcaagcaggcaaaagttctgtggagtcacactgtgaatgagagtggctaccgtggcgtatctgcagcagtccatgcagggtacggggggtcagtcaagtaggctgtatctgtatgtccatgagggaggtggttgtacacggcaggtatctggctcgaccacactgaggaaccgggaggaggcagggagtggatagtgtgtcaaggatgactgagccctgcttctgtgtgaaacaagttacacctagattcagaatagatgctgaagcaacataaaattataaaaattcactgtaattcacatcttggtgcctgggcaccagtttttaaatgtcagataagtgtaagtctgaggggtggatgcactgactgtaaggagaaagtggatttggtggtcatattcagaggcacaagtcaggagattctgatggaaagttggaaggggtagtagggaaagacaccagtgggtaggtggtcctctcccctagggagtaaggggttgactgatacgaggcaggtgtctcctgaggaaagcaacagtcaccattaattgtagtaactcattccggattttccttgcagtatggaagtgtaggggtgtacatttgagtggagaacaaggaggataccaggatcatgggctaaggaaacagtgggttcaggaagaaaaccaaaaaatgtcctgtgtcctgatgagtggaggttttagtgtcccaggggaaggaatcacaggggcaaagtcatctccaatggagaggtcctgggttgggtgatatcatctgggatgtgagactggggtatggctttttaagtgactgcccactcgagctgatgcaggcctctggactgtaaaccattaaacacccaaaccagtagcaatgagactaatattcaacaaaatgatatgtagctgtaccatataggggtttttattatttttttattttttttttggtggtggagatttaagctcaaataggtcccccatatcaaatgagaaactgcctggcccatgggacaatctatttttaataggtcccaggaaagaatgtgcccttgatctagctgccagcctttatgggatggcagcaagatcacaaatgtataaagatatgacctagggcaagatagaaactgttagggctttatttgttgggctgggatttgaaaaggagtcgtttgaggaaatcattatgcctctcgattaaatcattacctaacacctgtcagggacatgaaagttctactgaaagcatcttccaagaaaccagtattgtgttctaggaagtgaaatgtgtttcctggttaccaccagtaatatcttcaaggcaggagattctcagtgtttcttaccttgaaggaacaatttttttttttttttttttttttttgagacggagtcttgcactgttgcccgggctggagtgcagtggcgttatctcggctcaccgcaacctctgcctcccgggttcaggcgattctcctgcctcagcctccctagtagatgggattacaggtgcccgccaccacgcccggctaattttttgtatttctagcagagatggggtttcactatgttggccaggctggtctcaaactcctgacctcgtgagccacctgccttagtctcccaaagtgctgggattacaggcgtgagccactgcgccaggcctcaaggaacaatttttaggcaatgctccaattgtttataataaatgtaacgatgtcactacttgtaggccagggcattcagtgctgaggggcctgcctgaagtttggccaagtttgttttgaaattttaagtaatctaggactggcatacttgcgggacctggtgaatagggactatagggtttaaagttccttttctttccctcttgggcttgaagccaacaccatttttagttcctatatctgactgataggagaaaatgggggaggaggaaggtatctctaggcagcagccttttcttgggatggccagagactgtgagatcattagtccctttttctccccatactcaccgttttgttttttgttttgttttttctttttggcaaaatcttttagaatggccaggcagctaaataattatttttctttctttggatgtttatctgacgagctcctggggtcccatatggcaaccatagtaagtggccacctctactatggttgccatcagccggagtcataacaggcagcagcctcttttgaggatctccccattgaccttatccggatcaggctgtggccttccccaaagctcaagcacagaccgcctgatgtaagactctgcggctggggagtatgtctgaagaaaattgagtcaatatatattccacaccagagcaacatctatttgcttttatacaagaaaaagactcacaagcaatgttactagacatgttatattgtgtgccatgggagcataacacctaatgacaaaaaaataaaacacagaagcaaagccagttaagtaagagatatctagatgtcagccataaaccccagacccagctccaggagtctgtgactatgaacaccagcactgcctcagatatctcctgactccgctaaggactcaccaatcccacctgtgacccacatgaaggaggagaaagtatccccatcacataagcttggaaacaaatgtttacactaaacggctctctggtcacaaccagcacaaacgatattgtgactttttttttctaatcgcactccaatctgataggcagcctcacaaaaatatgtagaaaagcacaacactctacatgtatacacactaaaatactttaaattacagttaatcacagagctagagcttctacagtcttactactctcatttcttgacttacctccaaaactttcattacctgtcaggtcccccttgttattcctcattttctatgtctcaggaatgctattgatgctattgtattaaataactgtcatgccaaaggcacataatactataaagtttatttgcaatgttgagcagaaacatctatttcttttttatatcaaagcttattagaatgctctatcatctatggagtgtacagaatcatttccagatactcttgaaccaaaaaagaatctgagcctctcctaacaagtagttacaacaatgtagaaagattacatgggaatgttaaattggtaacacattttacctcaactctgtttccaaatatattttcagtaagttcaatgggcaggctaaaaggtaaaatctgtccctagaaggtatattatttttacaacaggatgagataatttaaaatgtattataataaatccaactcatgcattttaagcatctactcaattttcagtaatatgctagaaattttcagtaatatgctggaaactgctatgcagtttaaggataaatgttttactttattaattagctataggaaataatatacttacgcagtttttgtattttttaaaaatagtctaattccattttgttcaataagcattgatttactgtccaggtgctagtataggttgtttcagacttcaaggagctcttagcctagtattatataatatttactgtgtattataatgtcattggaattttggaaaatttcctcagaaaaacagaaaaggaaaagctatattgagatttttacaaggtattggccaacagtttctacctactgtagagggctacaaaaccaacatcaaaaaagaacaacacaaatctcatagctctatccactgagagggaccagaaggagtggcatcccagtaacaatgaacacaaatggcacccagattgaggtttctaaatacaatcccccaataaaaggaaccaaggttttttagggtcagcctagtgacagagtgagactctgtctcaaaaaaaaaaaaaagaaaattggttgaacccaagataagggcagtgaaaatacaaggtgtgcctagatcatcctgtggggtcagaaaataaagaagcagggccaggcgcagtggctcacgcctattatcccagcactttgggaggctgaggcagatggatcacttaaggtcaagagtttgagaccaacctggccaacatggtgaaacctcatctctactaaaaatacaaaataagccgggtgtgctggtgtggtgcctgtaataccagctacttgggaagctgaggcagaaaaattgcttgaacctggaagacggaggttgcagtgaagccaagatcctgccactgcattgcagcctgggagacaagagcaaaactctgtctcaggaaaaaaaaaagaaaaaagcgagaaatcaaataaaacaaaatagagaagcagatggcaaaagagatgaagacttgtcagaaggcatagaaggcaactcacaagaaattacactggccaaagttggcgtaatttaaacaataaaatgagcaataatagtataaccaaaagaataaatattcatgaagcatagtgctatgaatgaatgaatgaatggtaggctgagcgctgtggctcacgcctataatcctagcactttgggaggtggaggcagaggcaggcggatcacctgaggtcaggagttcgcaaccagcctggccaacatggtgaaacctcatatctactaaaaataaaaaattagccgggcgtggtggcacgcgcctgtaatcccagctactcaggaggctgaggcaggagaaatcacttgaacccaggaggcagaggttgcagtgagccaagatcgcgccattgcactccaacctgggcaagagagcaaaaactccgtctcaaaacaaacaaacaaacaaacaaaaaaaggcaacttttccttacagaaaaattataattaacaaatgcagaagaaaataagagaaacagaaaaacaccatgagaacattacagtggtaactgctccaggcaaaatgcaagaatggaaacaaaaataagtgggcaaaattttaagcacaaacaagatatcacgcaatctcaaagtatctctcccaagacacttagtaatcataaagataaaataaaattttatagtgaaggatcctaacagataccaccttaaacaagtgaacaaggttaacaccagtaatacatactgatatcatgtaccatgtacccctgaggtgatggaatgaatgagaagggcttatcgaatgtatggagtccttctcaataatgtaaccacagtctaatcacgagaaaacatcagacaaaccccaaatcaagggacattctacaaaatacctgaaaaagaattttcaaaaatatcaaggtcatgaaagacaaagacagactgagcaactcacagataaaggagactaaagaaacatgacaactaactgcaatgtgggatcctggtttggatcctgattttgctgaccctgcaatactctttaaattaactaatgctttcattaattaacaatgagttaattcttccttcctataaaaggtaaaaaaggaatagtgtttttaaatcattaaatagaaaaaagttggaaatacttattaaccagaagaaatttagattactctttaaattacagacttttaaaataaatatttgctaaatacaatcaatgtggtatcctagattagatcttgaaacacaaaaaaaagatattagtagaaaaactagacaaatctgaataaagtctggaaattagttaataatggtgtgccaatattagcttatcagtttttacaaaagtttttacaaaacccttaaagacttttaacaatagaggaaatcgagtgaggagtatacagggacactctatactatgaaacttttctgtagacctaaatttattccaagacaaaaagttttttatttatatgtcatcacttttaggtacctaatgattgccagatggaagcatgtcattatattaggccatattaagagccatatataggcttttttgactatatgatatacaatgacgtacatagttaaactcacagaatatcactgaatctcacttttcaaaagaatacatacatgtggccaacaatcatatgaaaaaaagctcaacatcactgatcattagagaaatactaatcaaaaccacagtgagaaaccatctcacgtcagtcagaatgcctattattaagaaatcaaaaaataacagatgctggcaaggttgtggagaaaatgaaatgcttatacactgttggtgggagtgtaaattagttcaaccattgtggaagacagtgtggtgattcctgaaagaactaaaaacagaattaccatttgacccagcaatttcattactaggtatatacccaaaggaatataaatcattctattataaagacacatacatgtatatgttcactgcagcactattcacagtagcaacgacatggaatcaacctaaatgcccatctatggtagactggataaagaaaatatggtacatatatgccatggaatactatgtaaccataaaaacgaatgagatcatgtcctttgcagggacatgggtggagctggaggccattatctttaggaaacttaacacaggaacagaaagccaaataccacatgttctcacttataagtgggagctaaatgatgagaacacatggacacatagaggggaacaacacacactggggcctgttggagggtggagagtgaaaggagggagaggatcagaaaaaataactaatgggtactaggcttatacctgggtgatgaaataatctgtacaacaaacctctatgacacaagtttacctacataacaaatctgcacatggacccctgaacttaaaagtcaaattaaaaaaaaaaagaatatcactgagtctcaattggaataaattgagacagtcacataaacagctcacaaatcctatcaatgaaaaagcacttatttcgagttactttgtaccagctaagttccatcctaaatgctgtgaaaagtgatttccttcatgtaacttaaagtccagcaaaataggaaggcatataaataaaaaataatgtgaaaaataatacaagaaaatgaatagagactaatatgaataacaccgcaataaaaacacacaagggttaggcacacaacaaaaatggttgactgggagacagtacagacttccctagagacagagagatggttgaactgagtcttcaattaggagcacaagttagccaatcctaagaaaaaggggacgttctcagaaaggaggataacatcttaaaggcacagggacaggaaaatccaaggaacatttgggaatagcaaagtgttagaagagaatgctggccatggccacggctgcagaaaaagccagagacgcagcaactgtcctaaagctgagggaagactaagagtgggagaagcaggacatgtagaatagtggaaaaggcaggatttcttctaagacaaaagagttgtagacaggctgaggatgtggaagaattcacagaacctttgaaataatttttttaaatttaaatgagttgcacagctaagctgtaaactttttttttgttctttcttttttttttaaaggagagagtcttgctctgtcacccaagctggagcacaatgggcgatctcggctcactgcaacctccacctcctgagttcaagcgattctcctgcctcagcctccctagcagctgggacttcaggtatgcaccatcgcatccggctactttttgtacttttagcagtgatggggtttcgccgtgttggccagtctggtttcgaactcctgacttcaggtgatctgcccaccttggcctcccaaagtgatgggattacaggcatgagccactgcacccagcctaagctgtaaactttaaaccaaatcaattgagaatttgttcctcaaaaaaagagtctcctgctcactctctctcgctgtgtgtgtatatgtgtgtgtgtgtgtgtgtgtgtgtgtaaatgagagaaaatggatgtgaaatgagttcaaaaccctcaagaaaacagaagaagaaatcatttaactgtaactcaaactcaagcctctatggtggcttttgattcattaccacattacagtaactatcataaaagcaaagtttaaactgacaatgttggatatagatgctctaagcaggaagaaatggtaagaaaatgtgttctcaagtaatgcatgaaaaagaaaattcagtgctttctgttctttaaataggtattgaatcctggatttaatggagaaaaatcccttattgttcgtgatgccataagcaattaagaccagctagaactcattaattgctgaaaaaatagccgtaatattctcattctatttatccaatgcagcttagtattcaaggttaacagcagtctaaaagaagaggaaagaatgaagaagaaaacaagaaatgtaataggaactaaagggagacagcacgtgatattaaaagggaaaattataattaagttttgactgtcacagttttttttttttttaacactctgaaatatgtggtggaaactttcctcattaaactgaatgtaaaaatgtagaaacacatttatttctagagcccagaaacaagttttgatacaaaaaaaaaattatttaaagaaagattcccactaccagcactaaactgttcatgtttttaaagtactactgtagtacagaaacaagttccatagagaagactgttaggtagtttccattccaaataagacagccaaagtcatcccttccagctttgaaagtgaccaaaaaaaaaaaaaaagaattttaaaaattaaaatagttctgtgctgtatttaaatgataaattggatattaaagcttaaacattatttgaaagaaagcaattaacatattttaaaattagcttttcctcttcaaaataatgatataatcattctggaccaaaacagtaattatatcttctcttagatataatctcttagaacatataattattgcctgtcaattttttactacccttttgaggtcatatgtgatatttattccctcttgtttcaaataggtaaggaagagcttactgcccagtatgcgcttggaggggagggtggatacagaaatctgtagtgtagtgtaagaagaaagagtagagaagaaaataaacagaataaaaacagttgttttttttctaaattgcaagggatgctgtcaagagaatcaaaagaaaagccacagactagaaggaaataaatgacatatttgataaaggatatacaatatacaaagggcccagtgcagtagctaacacctctaatctcagcatgtggtggtgcgtgcctgtagggccagctactctggaggctgagataggagaatcatctgagctaaaggaagtcgaggcttcagtgagacgtgattgtgccactgcactccagcctgggcaacagagtgagaccctgtcttaaaaaataaataaataaataaataaataaaaataacaacaaaatatataatgaattcttaaaacccaaaaacaaacaacccaattcaaaaatgggccaaagaccttaacagacaaatcaccaaagaaggtatacaaatggcaaataagcacattaaaagatgctctacattatctgtcatcaaggaaatgcaaattaaaacaacgagctatttctacacacctattagaatagccaaattccagaatgccgataacacttcatgctggtgaggatatggagcaacaggaactctcattcattgctggtagaaatgcaaaatggtatagccactttggaagacatttggcagtttcttataaaactaaacatactcttaccatataatccagcaaaggaacttcttggtatttactccaaaggagttgaaaatttaagtccatacaaaaacctacacatggatgtttatatcagctttattcatagttgccaaaacttgaaagcaaccaagatgtccttcagtagatgaagagataaactgtggtacctccaccacacaatggaatattattcaacactaaaaggaaatgagctatcaagccatgaggaaactgaaatgcattttactaaatgaaagaagccagtctgaaaagactacatctgtatgattccaactatatgacatttaggatagggcaaaattatagagacagtaaaaagatcaatgggccggatggggtggctcatgcctgtaatcccagcactttgggaggctgatgagggcaatcgcttgagctcaggagttcaagaccagcctgggcaacatggagaaaccccatctctacaaaaaaaatacaaaaatttgccaggcattgtggagtgtgcctatagtcccagctacttagaaggctgaaatgggaagttcgcttgagttcaggaggtggaggttacagtgagccaagatcatgccactgctctccagcctaggcaacagagccagaacccatctcaaaaaaaaaaaaagccacagacacacacagagagatcaatggttgtcaggggtcaggggaagtggcagggagaagggatgaataggtagagcacagtggattttttggacagtgaaactgctctatgtgattctataatggtggatagatgtcattatacacttatcctaacccataaagtatacaacagcaagaatataccactctggtaggggatgttgataatggacgaagctgtgcatgtgtggggttgggggttacataggaaatctctgtaccttctgcttggctttgctgtaaacctaaaattcctctaaatttttaaaaagtaagtgttttgcttcttaaaatactatttgtatcaagatacaaaattaagatccttatctcagttctggtataacaatctctgcaaaaacttctataaaactactgcatagtacaatagaatattgaaatgtttccaccagatgaaatgtactgtaatcaaaatcatcttccatactttttaaagcagagaaaaggaataacggtgactaacgaaaaataactttttttaaaaaaaatgacaggctctcgggctctcattgtgttaccaggtgaactcaaactcctgggctctagcaattctcccagaaataacatttttaaataaaaatagtaaataaaaattactgtggcacagggtagctgtcatgaatgacccaccaaaagttttaccaaatatctcaagtgtgattatcactcatacctgttccccattcccttcatcccagcccagcaaatctctgaatgaggttcctgctgggcactgcttgcctgaaggttccccaactccacaccccctctaccttgcttgttttcacaaatgtattcccaaaggagacaagaagtcaaaacttgtccttccaaaaggaaaaagacaaatgctaaatccttgtgagcagcttcagtcagaagggagcaggaaccctgtcaggctacagagggcgctacaacatcctcagcattcaggaaggcacctagtagcttggcccagtgagggtagaggataaaggaggggaaaaagagggaaggggaagaaagggatgagaagtataaggaaggagacaggggagaggatatgaacaagaaagtagaattaagaagaaagactaaaaaaaaaaaaaaaaaaaacagaggcgtgaaaaaagtagctagctcctcaacatttataagttctacaaacagaaagacaaattcaaggccgggcacagtggctcacgcctgtaatcccagcactttgggaggccgacacaagcggatcacctgaggtcaggagtttgagaccagtctggccaacatggtgaaatcctgtctgtactaaaagtacaaaaattaccgagtgtggtggcgtgcacatgtaatcccagctacttggtaggctgacgcatgagaattgcttgaacccggaaggcggaggttacagtgtgctgagatcctgccactgcactccagcctgggcaacagtaagactctgacttaaataaaaaataaaaaataaagacatcttagagttttttacagtactgaggttttaaatgaaatctaaagctcttgttttcattcctcctatcaaatgttaacagtatccccactacacatgcttcttatttcattcatctgtaaaccattcctgtcaactctcaaatgtaggtctagtcagtcccaaggtcactgagcacacaggcttctccatttaataggtttaggatacaaccttgttgctgtaagattcttttcagcccttttaatgtgtcagtccaggcttttaatacctttcatcaaactattacttataactggtctcacaagaccgattgtagtctaggttgaagcctgaccctctaaatttacatgttgtgacattctttaagaatttattgaaaattatggcaagaacatttgtactgagaccaaaaaagcaatacattttataattttggctatcactaagaaaggcttggagtttgacaaggtagaaagggtggtgggaagcattgctttggagaagatatgtatgttcaagatcagaaaatactgtaacatttcatggaaaaaaattccataaaatactagggtataaaaatcacgtaaaaccaaaagatgtgttcattaggcacccatgaggtgccaaacactctgctagctgacaataatgaacttttttaaaaagtaagcttatcaaagactagtgtacatacatacagaaaagtgcaatgataataggtatacagtttgatgaagttaaactaaatcaacaaacccaataaactacctctcagttcaagaaatggaacattaccagtttcccagaagccttccccagtacccactaacattactacaccccacaaactagacctgccaaaaggtagtaccatcctggttctgaactttttattaacagaagcatagaatacacatgcttatgtgtattgcttatgtgtatggcttatgcatagaatacacatgcttatgtgtatggcttcttaagagtcattcacattactgagtatagcagcagttagttcatattcactaatgtagatcattctgttgtaggaacattctacaatgattgacagttttaagctattataagtagtactctagaaatattcttgtacatgtcttgtacatgtacccacacacacatatgcacattcctaggagtagaacagctagatccttgggtatgtttatgtttaactttactggcagttttcctaagtgctcacatcaatttacattcccaccagcagagtgagaatttctgttgttctacattcctgccaatacttcattgtctttagcaattctggtggtggtgtagtgaaatcaccttgtggtttaatttgcatttccctaatgactaatgaggctaggcacctttcatatgtttattgtatatattggacacttacgaagtgtctgttgaagtctttcattcactttttctattggattggctgccttttctgaattgatttggcaaaatcctttatatattctggacacaagtacttggtccaaagcttttaatctatttagtatgaacatgatacacacagggaaaagacaaagaacagtgtaagatcaaagggtaaggttatgtaaccagcctatgagtgttctaggaacacagaacaaggaataatcaatttaaggttattgtggacagagaagaatatataaagaagggaaatctggaggtgaaccatcaagaaatttaatacatttatcaggtagaacaatatgcaaaagcataaagagccataagcagcaaaattcaactcagaatgagccttattcctggattaacataatttcctctcctaagggtcaaatctttcctaaggttcaaatctttactgggcacaaaataggttggataaaaatgagggcagatgacagtagtctatggagttttgaacagaccttacttaacacttcaaataccttatctcatttaatcacaaccctgtaatataggtatttaccaaagaaaagtcacctaatgtcacagctaatcagcagtggaattagcctaagcactgaggtctgccacttctaaagtccatgatttttccactgaacagtctgtatctcaacaagcaaaattaaagttcccactatggtagctcctgggaactgaagacaaaaacaataactaaactggaacatcaaaagctttagaatttcatataggtaatgtttggtcttcttatataatgcatttcaaaaaaatgtgctcaaattgaatatccaagagtcaaactggaaaagtcaaacaacaggcttgctgaagtgccacaattctaaaatacctgtatttcagaatgacaccattaattctgtaacatcttaaggtgaacacattaaatgagcacatttattacacggtatcctgatttcagaaatgaggaaagtgttacaccttagaaccaagaaagcacaataaatgttatgagagattatctattcccagtgcaatagaagtttattaaaatccctaattatctgtaacgtttttagaaacaatcttcaacaaaatagttccagcatttggtacatgttcattaactgtgttcttctgcctcatcattaaacacagcttaaatctaatgagcatctaattgaggttaaagacccatcctaatgatttccatctttatctcaatcacattaagattatggctataccactgggtgtgtgtataaatatatccatgtgtgtgttcacacaaatacataaagccattctctgatttcaacttatttttataaaatgggataatgcatttaatctgttacacaaatatatactgctgtgtagacagggatagcacaccgccaaaacccaactggtaacaggaaagtggctatattagtttcctgtggctgctgttaacaaactaccacaaactttgtgctttaaaataacagaaacgtatttccccacagttctggaggcgagtagctcacaatcagtttcactgcactgaaatcaaggtttcatcagagctgcgctccccacaaaggctctaggggagaatctgttctttgccttttcctggtggccacggacagacattccttgacttgtggccccatcactccatgtgtgtctccatcttcacagtgccttcgcctctgtgtgtctgtcaaatctcaccctcatttcactaggatacttaagatgaaatttagggaaaactcagataatccaggatgatctctttatctcaagatccttaatttaccgcatctgcaaggatcctttttccaataaggtaaaatttacaggttccaggtattaggatgtggacattttggggaaccagcatttggcctacaacagcagcctactgtaaaactgttgagcattctcatcagttaatatacaaggccccaactgtagacagggtagggaattttaatgtgtactgtatgaaagttcagagtacactgaaggccaaaatcaagaaaaatcaaagactaccagtgtcatgctacagatgtctattagtagtgagagcctggatcagggttatcaactctgactgaacattaaaatcatcttgggacattttaaaactactgactctagggccacacctgagactacgccttacaatctgggtatgcagcctaggtttggttggattttttttattaactcaggtgatccaaatgtgcaaccaggtttgaaaaaccactagcccaacagaataacaaaataggatggagaccttaattatacagtaaactgtttttggtttgtttttgttatttttttaccaatttaatgcaaccacctcttctcgttagggagaaaagattcctttaaaaatcacgtttgtaacttaatttgaaaatatgttcagattaaaagttctaaaaactgatgcatgacacttttagccaaatcagagtatgttagcagaatgtcaaacccaaacccaaatacagtacaaaataaatgtctagttcataaaaaggaaccgccagttagttcatttaattgacctttctctaaaagtatcaaatgcttgtttggaataagccactcatgaaaataatcatattgagatcattttagaattatacttgctgtttcatgattttatttttatatcaaagaccactacactaaggcatgagaaatgacaaacaaaattcagagactagaaaagatgattaatccaatccttttttttttttttttttttttttggtagggatggggttctcactgtgttgcccaggctggtctctaacgcctggcctttaacaattcccctgccttggcctcccaaagctgacaggcatgagccatggcatcccactgtaatccaattctttatcaaccaggccagttacacaaactgagggttttattttcctgtctctgattcctcttcattctttctggggctgcacttttatctacttacctaggattgtttaccacctccactactgagaaagagaagggaaactcaaaagtcagttgattctattttgaaatgtgtattttttgaaatgcctcctatttcaaaggaaagcctatacacgtcaacagttgggcataaatgttaatgcttgttaattttgcttagaaacgccatgttttactttgattagtatgatgaataactgcaaaggtggcaaaaacagtatctcaataaactgatttcacaaatgaaggaagattagaccaggaagtcatacaacggttggattttcattgttacccttacttctcactacatggataaaaaattaccaagactagaacacacacatatttcaatattgaaactgttaagtaagagttactaaatctttgatttaacatacgtattttattcacatacaatgaaaggcaaaatgtatggccagtggaaaaacttcaaagccaagtcacctatcaaaatgttcagagcttaaatctgccaagataaaggggttaagctgtcagcttctagatgacggagagaggaatttattcagcaacttcccttcaagatgtgcaaaatgttttcagaaatccgtacctatattatgtcttgttctctggtaaatacatgcataaaaacagttactgaatataaacaggtgttcagtaaaccatgattccaaaagtcctgtataaattgcttgcacattttgggttttgcttgctctgtagcccatcctctacatcctgggtttcaatcgattctcctgcctcagccttccaagtagctgggaatacaagcatgcaccacgacatggataattttttgtgcttttagtagaaatggggtttcactatgttggccagcttggtctcgaactacttatctcaagtgatcggcccaccttggcctcccaaagtgctgggattacaggtgtgagccatcgtgcctggcgctgcttgtacattttgagcaaattatgtattacatattttatttacatctttttaacctaatttaattcatctacttatatttttaagatacttctagtttttttcccaaaaaagaaaaatccaagaataatccagttttgcttttagcttttttttttttttttgatacattgccctttttctcctctctatccaatattcagttgctttttttttttttggaaacatagtcttgctcttgtcacccaggctggagtgtaatggcgcgatctcggctcactgcaacctctaccttccaggttcaagtgattctcctgcctcagcctctggagtagctgtgattacaggcgtatgccaccacgcccaagtaatttttgtgtttttagtagagacagcgtttcaccatgttgtccaggctggtctcaaactcctgacctcaggccatccacccaccttgggctcccacagtgctgggattacaggtgtgagccactgtacctggcctcctttcaactttatattcacctatttttatcttttttaaaagcaccacttgcctttgttttaattctctgtcaagcaattaattgagatttcatcctgctggcaaccactctagttctgcagcatcctcaatgagaagcaaggtccacttctcatttgtcttcctttcaactgtttctatttccacactttcactagcaatattaatttcaaccaatttctaagacaagaagtatgccactgaatgtataactgatcttaacaacagattaacaaattgttgattccctgccattttcaaaatatcaaatatacaagacagtaatttttttaaaatattttttcatctctgagggaaaggatgatttgaagactcctttcaaattcccaagaaagcctctcaatattatctgtgtaaactactgattcacaggaataaatatttgttatttaatataaactaaaatgaaaatttttagctttcacaggaaaagctaaaaattttcattttagtttagactaaataacaaatatttacaaaacattcactattcgttagcttagtgacagacagcactattcaaaagcccacaaaaatgaccaaattaaaacgattgcaagttgttttcacagctatgttccattacagatttgttaacggcccctaaatgtcatggcctcaagcgaaacattaaaccttatcagccatcatttaatctgtaaagtgaagatattcaactatgtgataaagtcttcacaataatctagaaaatactgcttagccaaagtgaccctcgcaaacattcaccagcaatactttaaaagattaccttctgttgttagaaatacattatggaaaaatgtaaaaaaataggaaaaaaaaatatatatatataaatcactcaaaccatcacccaagagtaacaactgtgaaaatttgtggaatagtaaaagacaccaaaatgtaatatgttcataatcgtaaaaaattaacacagttgcagtcatatagtatataatttgagcctacattttcaacttgtatcataaattctgtcctaggtcattagaacatttaagaaaatgtcatcttgctctctccttccgccacccaaggttcccaaaggaaagaaggccaagagaaagaaggtggctccggcccctgctgtcctgaaaaagcaggaggccaagaaagtggtaaatctcctgtttgagaaaaggcctaagaattttggcattggacaggatatgcagcccaaaagggacttaactcgctttgtgaaatggccccactatatcaggttgcagcagcagagccatcctattacaagcggctgaaagcacttcctgagattattaaccagttcacccaggccctggaccattaaacagctactcagctgcttaagctggaccacaagtacagaccagaggcaaagcaagacaagaagcagagcttgttggcctgggctgagaagaaagctcccagcaaagggcacatccccactaagagatcacctgtccttcgagcaggagttaatatcatcaccaccttggtggagaacaaaaaggctcagctggtggtgactgcacacaacatggatcccattgagctggctgtcttcctgcctgccctgtgtcgtaaaatgggggtcccttaagtgcattaccaaggagaaggcaagtctgggacatctagttcacaggaagacctgcaccaccgtcacctttacacaggttaacttggaaggcaaaggagctttgactaagctggtggaagccatcaggaccaattataatgacagatatgatgagatctgccgtcactgggtccctagactgtggctcacattgccaagctcaaaaaggcaaaggctaaagaacttgccaccaaactgggttaaatgtacactgttgagttttctggaaataaaaataattaaaataaaacaaattttccttcaaaagaaaagaaaagaaaagaaaatgtcatcttgatggctgtttaaaaaatctaccaccagaatgtaaattggtacagccattatagaaaatagtatggaggttcctcaaaaaattaaaaatagaactaccatatgatccagcaatctcactactgggtatatgtcctaaggaaataaaatcagtatcttgaagagatatctgcacccccatgttcactgtagcattactcacaatagccaagatatgaaaacaagccaagtgtccatccacagatgaataaactgtgatacatataagcaacagaatattattcagtcataaaagagaaggacatcctgccatttgtagcaaaatagatgaacctggaggacattatgctaagtgtaataagctagacacagaaacacaaacactgcatgatccacaggtagaacctaaaaacgctgaagtcatagaagcaaagaaaggttgttgccaggagctgagaggtgggagaatcagggacatgttagtcaaagggcacaaagtttcagttaaaatctaacttctggggatctcatatatatagcatggatggtgatggatatgtgaattaatttgtggtagtcatggcacaatgtacacgtatatcaaatcatcaggctgtataacttgtactcaatcctaatttgtcaattaaatatttttaagtaaataaaagtcatccttaaaaaaaagctaccaccagaatattcaacagttattatacaaaatagggatatttcgaaagagaaatgtttagcaaatttatttctaaaaattttgtaagtcatgtcttcggaaagttgctaccgtgggagaactgacccaacttttaaaaagcaagtcaaatgaacagcaatggcaacgatgggaaaaagtcttcattagaaatgcatctttagagctttcaacatctgaaaaagagaaaggtccaatttaaatagtgatcctatggccctattttaatcctttatataagctatcaaacagatcattccaaataatctaaagtttagaaatagttatgaattcatgcaatcatgtgaaaagttctgaactttagtagcattccccttcatttttcactctgctttgtcctccttggatgaacagaacactgtgttctaactattctcctcaataagcacactaaacacataagcacttagaaaattataaagaaaaggccaggcgtagtggctcacacctgtaatcccaactttgggacgccaaggcgggcggatcacgaggtcaggagatcgagaccatcccggataacacagtgaaaccctgtctctactaaaaatacaaaaaattagctgggcgtggtggcaggcgcctataatcccagcaacttgggaggctggggcaggagaatggcatgaacccaggaggcagagcttgcagtgagctgagatgatgccactgcactctagcctgggggacagggcaagactccatctcaaaaataaaacaaaataaaataaaataaaataaaaagaagaaaattataaagaaaaaatagattaggaaccaaagacatgaactaatcatggtttgctcaaacaagaatgagcagatcaaacttcaaagactaagtcttttatagcaggggtccccaactcccagggcctaatactggtactgttaggaaccctggcctgttaggtacggggccacacggcaggtcagcggcaggtgagctagcgttaccgcctgagctccacctcctctcagatcagtggtggcattagattgtttctcataggagtgtgaaacctcctgtgaactgcacatgtgagggatcttggttgtgcactccttataagaatctaatgatgaatttaatctgatgatttgaggtggaacagtttcatcccgaaaccatccccccaccccatccatggaaaattgtcttccatgaaaccagtccctggtgccaaaaaggttggggaccactgtttttccatcacataatgtaagaaaagaagtacagcagcaccacagggtcaatcaggtctaccccagaaagccctggtgccaaagaggccacagccagcaagccttttttaaacacaatataacttttaatagaaaccaagaaaaaaggaaatgcgcaaccaaaaaaatcaatcataaaatatttgagtaatgagagacaaaaaaatagttactgaaagaaaaccatattctattcgctcagcaggaagagactctgcaaggagcacacgtttaggattacaatacgtactgaccagccctgaaccagcagggtcttggtacagcagagatgctcaccagaattaaattcagttcaggagacattagctgatcctctcaactcccacatgtcccacatcctcaatgacatcactgcaaaaactgtttgataccggcaagtgttaggagaaataggaagatgcccatccatttttaagctagaaatatccaaacaatgcataaattagacccaatgaggttgccttttaatccaccaagaggcagacatgactatgtgattttattactaaacaaaacttgtaaggacctcctgtacttattaaatataaagtagcttttaaaagtccatcacaggtatatttctgactgtaatttttaaagggggattttttttcttaatgtagtcaagcaggcaaagagccaatcaatccattagaaaaatcaaagagccagaaatctatgctttgtcattaattcagccatgcgactaccattactaccagcatctttaaaaacaaaacaaaacaaaacaaaacaaaacaaaaaaactggacagcagggaataaatggatagcaaaacagaaagaagaaaatggctttgtggtatttatcctacaagtgaggtagagctcatacttctagctcatgcttgtccttgggagtgagcaagtgtccagggttttggcagggcacacagtaataaaagaagacaccatgagaaagccttttctgactccagattttgatgggtatcatttaggcaaaaagagtatactgggattattcaacccttttccccactgcctttaatactgagcacgccataaaaaccaatatgcaatgctagcccgtaaaattaaaatgctatatgcctactgttctctcggaatcagtctaatgagccaactgtagccacagttagcttagaagaaaaagtgaaccaaagggaaaatagtaacataggtaaggcataatactgtaatcaaagtcccttcaattttaaattggattactgatgagtcttcctgaagggtaatcttttgtagtagtgcctattttgtttgttttaataaaatctactgtgtgcatcttttaaaaatacaaaattactacaaactacctagccaagactattttttctccactccagtatgggacgactcctgcaggtagtagctgtttaactagaaaaaaaaaaaaaaactgccaacaagcacatactgtgcagaaaacataagcactacatttatagacagcagcagctttccagaacatctatgatggcagcctgaatgaagaacaaccgtctggttcttcatttataatgaaggtttcagaaacacaaacatccaggaccatgaaaccttaggtgccctgcattgccagctgtaaaactatagatgggaagtcccaaagtagccaattatttaaggccatatatgagctgtttcaacatatgcattcatatacacttacctttctcttaactacagatatttaaaatattatacattctgaaataggttgaaaaaagcaaatgagtactcaatgttattaaagctgggcaagaaagagctaaggccaaatcaatgcatactacatacagaatagaatgtattccatataagtgaaaatattacatttgtctagagtagggggcagagttattttttaatctgttacggaaatgtacaatttacagaaaatgatgtattctttttgtacaagaaaatatattttagataggctttcttatctgaagaatgtttttattttcctacagatgattatctcaccttcataaacatcttgagtcataagctccagtgcatggttttcctaataaaagaacacttaacatttttcacccatttacactttaaaaagaagcgggggtgagggagtcctgccaattcacatgtatacatctcaaacaaatccttggttccaatgtgaattttcacatggttattttcaaatatttggactaattcagatataaagcaatgcaagctacaaaagctaaatgtaattaaaacaccaagaagaagaaatttaaaagcactaccattaaatttataaacttcagatcctgcagatgatttattgccctatgaaaataaagtctaagttgcaaaatgtatttgacagacatggcatattataagcactccaacatcaaagtatcatagtttatgctgtccaaatacattaatcttcatcttagcctaggtttgaaacatatattttaaaaactaattacaaatcagaagacaaatgataaactacatggcagacttataatattccttaatataaatgcaaggttcatataactattaaaagatttggaaacctccactgacttgagaagataaagtctcccattataccatctgggtgttagaattcttatggaaaaaaattatttgtgccccatgtgttcattattgctgatggaattagaaaggttagtttttttagaacctaagaatttagctactattctcacttttatttgtaaaattcaaagtaataaaatataccacattgaaatagcacttaatgagtgccaagcactgtgtttaatccaattaactcttgaaacatttctctgaggtagtttctaacattatcttcattttacagataaggcaattgaaacaaaggggtcaaattacttgcccaaaatttataagtaagtaagtaacacagctgaaattcaaatccaggcaatctggctccagagtcttaaccacatttctagagcatgccatattaaacaatcccaaccttctttcctggcttccaacctccacctcaatatcaggaatacctgagaaggcaaacattcctatctaaattcacaccatctgcaatttcttttgaaaaagtaaattcgtataccaaagttgctccaaacatgcttgagataaaagagaaaagaaggaaattcccttacacttcccagaaagagaaaatgaatacaaaatgcaaaaatttataaactatataaaattaaagaagtaaggcattacaaatcgagtttttaaacattcctatttagtcccttaaaaacataaataaaacaccaatgttttttaaaaatctgcacaggcatacctcagagatattgtggattcagttccagatcaccacaacaaagcaaatatcacaataaagcaagtcaagtaaattttttggtttcccagtgcaaataaaagttatgtttatactataatataatatacacatgtgcgatagcattatgtgtttaaaaaatgtacatgccttaactttaaaatgctttattgctttaaaaaaaatgctaacaatcacttgagcattcagcaaatcataatcttttcactggggagcagtaatgcctggatgttgattgctaccaactgatcagggtggtggttgctgaaggctggagtagctgtggtgatttctggaaataagacaacaatgaagtttgctacatggattgactcatcccttcacaacagatttccctgtggcatgtgatgctgtttgatagcattttacccacagttgaacttcctccaaattggagtcaatcgtctcaaaccttgccactgctttatcaactaagtttatgcaatattctaaaacatttgttgtaatttcaacaatgtttacagcatctttaccaagagtagtacattagtccattttcacagtgctataaagaactacctgagaatgggtaatttataaataaaagaggtttaattgactcacagttccatatggcaggagaggcctcaggaaacttacaatcatggctgaaggctgaaggcaaaggggaagcaaggcacaccttataggacagcaggagagagagaacaaggggagaagtgccacacttttaaaccatcaattcttgtgagaactgactcactatcacaggaataacatgggggaaatccacacccatgatccaatcacctcccactagatacctcccctgacacacggggattacaattcaacatgagatttgggtggggacacatagccaaaccatatcattcttcccctgacccctcccaaatctcatgaccttctcacactgtgagatcaatcattccttcatgacagtccccgaagtcttaactcattccagcattaactcaaaagtccaagttcaaagtctcatctgagataaggcaagtcccttccacataaggaaggtcccttccatctagaagcctataaaatcaaaaacaaattagttacttccaagatacaatggaggtacaggcattgggtaaatgctcccattccaaaagggaaaaagtgcccaaaacaaagaggctacaaaccccaggcaactccaaaacccagcaaggcagtcactaaatcttaaagcttcaaaataatctccactgacttcgtgtctcacatctagggcatgctgatgcaagggctgggctcccaaggccttgggcagctctgcccctgtggctctgcaaggtagagccgccacagctgctttcacgggctggtgttgagtgtctgcagcttttcctggtgtacagtgcaaggtgtcactggaggacgatggccctcttctcacagctccactaggcagtgccccagtggggattctgtgtaggggctccaacccatttacctcctgcactgccctagtagaggttctccatgtggcctccacccttccagcagacttctgcctggacatccaggcatttccacacatcctctgaaatctaggcagaggttcccaaacctcaattcttgccttctgcacacccacaggtccaacaccacgtggaagtcaccatggcttggggcttgaaccctctgaagccatggcccaagctgtaccttggccccttttagccatggctggagctgaagtgggtggggctggagatggagcagctgggacacagggtgccatgtcttaaggctgcacaaagcagcagggtcctgggcctggcccctgaaaccatttttccctcctaggcctccaggccagtgatgggaggggctactgtgaaggtctctgatataaccctgggggcattttccctaatgtcttggctattaacatttcactcctctttactaatgcaaatttctgcagccagcttcaattcctccccagaaaatgggtttttcttttctacgacatggtcaggctgcaaattttccaagtgtttatgctctgcttcccttttaaacataagttcgaatttcagaacatctctttgtgaatgcatatgactgtatgctgctagaaacatccaagtcaaatcttgaatgctctttgcttagaaatttcttccaccatataccctaaatcacctctctcaagttcaaagttccacaaatctctagggcaggggtaaaatgccaccagcctttttgctaaattatagcaagagtgacctttactccagttcccaataagttcctcttctccatctgagaccacctgtctggacttcactgtccatatcactatcaacatttttgtcaaaaccatacaataagtcttgaggaactcacaaacttcaacatcttcctgtattcttctgagtcctctgaactgttccaacctctgcctggtaccccgttccaaagttacttccacattttcaggtatctttacagcagtgccacactaccagtaccaattttctatgttagtctgtttttgcactgcaatgaagaactacctgagtctggataatttataaagaaaagaaatttaactgactcacagttctgcatggttgaagaggactcaggaaacttacaatcatggcagagagagaagcaaggcacatctcacatggcagcaggagagacagcacaaaggaggacctgccacacttttaaaacttcagatctcatgagaactcactatcataaggcccgcataggggaaatccgcccccatgatccaatcaacacccaccaggtccctcccctgacatgtgggaattacaatttgacatgagatttgggtgaggacatagagccaaaccctatcaagtagcttccatctcaaagaaaccacttttgttgttcatccattagaagcaactcctcatctgttcaagttttatcatgagattgccgaaattcagtcatatcttcaggttctacttcaaattctacctcttttagtacacctaccatatctgcagtcatttcctccactgaagtcttcaacccctcaaagtcatcaaattcttccaaaatcctgttcatgttgatattttgaccccctcccatgaatcacaaatgttcataatggcatctagaatagtatatcttttccagaggttttcaatttactttacccagttctatcagaagaatcactatctatggcagctgttgctttatgaaatatatttcttatataatagtaagtgaaagtcaaaaattactccttgacccatgagctgtagaatgggtgttgtgttgccaggcaagaaaatagtatcaatctcctcatacattcccatcacagctcttctgtaaccaggcacatggtcaatgagcagtaatatttttttttttttttttttttttgagacggagtcttgctctgtcgcccaggccggactgcggaccgcagtggcgcaatctcggctcactgaaagctccgcttcccaggttcacgccattctcctgcctcagcctcccgagtagctgggactacaggcgcccgccaccgcgcccggctaattttttgtatttttagtagagatggggtttcaccttgttagccaggatggtctcgatctcctgacctcatgatccacccgcctcggcctcccaaagtgctgggattacaggcgtgagccagagcagtaatatttttaaaggagtcttttttttctgagcagtagggctcaacagtgggtttaaactattcagtaagccatgcagtaaacagatgtgctgtcatccaagctttgctcttccacttctacactacaagcagagtaaaattagcataattcttaaggaacctaggattttcagaatggtaaatgagcagtggcccttaacaagaaagccatcctgtcctttgaagatttgaagctaggcattgactcctcatcctggatggtatcttcaccattagaaagctgtttggtttacattgaaaatctgttgtttagtgtagccacctttctcaatgatcttagctagagcttctggataacttgctgcagcttctacgtcagcacttgctgcttcaccttgcactttcatattataatggtagcttctttcttcaaatatcatgaaacaacctctgctagcttcaaacatttcttctgcagtttcctcactcctctcagccttcaaagaattgaagagatttagggccttgctctggattaggctttggctcaagggaaaattgtggctggtttgatctacccagaccactaaactttctccatattagcaataaccctgtgtcgctttcttaacattcgactgttcactgaaggagcacatttagtttcctgcaagaaattttccttcacactcacaagctggctaactacttggtacaagaggcctaacttttgacctaactcacccagcttttgacatgctttcctcacagcacttaatcatttctagcttttaatttaaagtgacagacatgcagctcttcctttcactggaatacacagttcaagtcttacatgggtatggcttatggtgcccccaaaacagttacaatagtatcttcaaagatcactagtcacattcccataacatatataagaataatgaaaaactggccaggtgcagtggctcatgcctctaatcccagcactttgggaggccaagaagggaggattgcttgaggtcaggagtttgagtctacagcgggctatgatcgtgccggtatactccaacctgggcagaagaatgagaccctgtcccagaaagaagaagaaggaaaagaaggaggagaaggagaagaggaggaggaagaggaagaggaagaggaggaggacggaggaggaaggaggaaggaggaggaggaggataaaaggaaggaaaaggaggaggaggaggaaaaaaactgaaaacattgcaagaattaccaaattatggcataagaacacaaagtgagcatatgctattggaaaaatggtgccaatagacttgcttgatgcaaggttaccacaaaccttccatttgtaaacaatgcattatctgcaaagcgtaataaagtgaagcacaataaaacaagattcccctacaacaggggaatcaaaactgtgtagtactgtcctaaagacagacatataaataaacagaacagaatagagaacccagaagtaaagtcttatagatatggacaaatgatcttcaacaaggatgccaaggctacacaatggggaaaggatagtctctccaacaaatggtgctgagaaaactggatttccacatgccagaaaaagaagttggattaagaccaaaacataacactttataaaactcctagaagaaaacataggggaaaaccttcagaatatcggatttgggagggatttcttaagcatgacagcaaaagtataggcaacgaagcaaaagtagactaatgggactatatataccacgctcacaaacttccatgcaggaaaaaaaatgaaatgaaaaggcaacctatgaaatgggaataaatatttccaaatcatctatttgataagaggttgaacaggacttgaacagacatttctccaaagaaaatatagaaatggccaagaggcatatgagaagatgttcaacatcactaattatcagggaatgcaaatgaagccacaatgaagtaccatcttttccacgtaggatggccactactgaaaaaacagaaaataataggtgttgacaaggatgtaaagaaattagaatccttgtgcactgtcattggggatacaaaatggtagagctgctatggaaaacactatgaacattcctcaaaaattaaaactagaattaccataggattcagcaatcccatttctgggtatatatccataggaaatgcaatcagtatctcaaataaatatttgtacccccacgttcaatgaagcattactcagtcgggcatggcttatgcctataatcccaccactctgggaggccaaggtttgaggacagcttgaggccaggagtttgagaccaatctaggcaacaaagtaagaacctgtctttaaaaaaaattaaaaattagccaacgtggtggcgcacatctgtagtcctagctacaggctaggctatagctgaggctgaggtagaagggccatttgaacacaggagctcgaggttacagaaagccatgatcacgccactgcaatccagcctgggtgacacagcaagacctatctctacaaaaaaaaaaaaaaaaaaaaaaaaaaagcagcagcagcattattgacaatagccaagaggtaggaggagcaacctaaaagttcattgaaagataaataaacaaaatgtgttatatacatacagtggaatgttattgagtcttaaagaaattctgtcatatactataagagtgaaccctgaggacacgctaagtgaaataaatcagtcataaaaagacaaataccacatgatcccacttacatgaggcatttacagtggtcaaactcacagaaacacaaagtagaatggtggctgcctgaggcctggggtgaaggggaggggatccattgttagatgggtacagagttgtaatcacacagggtgggtggaaggagttctggggaactgtttcatagcaacatgcatgtggttggcaaaagtatactgtacatttggaaactattggagggtgagttttatgttatgtgtaaaagtttttttgccacaataaaaacaattagtacacaggaatatattacctatatacaaagtattatttaacaaccttgtattttagtcatacatctttaaccgtattagatttaaatcagcccgagcagcaaatctatttgttaaacattcatattcaattatgaaaggggaccaggtccagtggctcacatgtgtaatcccaacactttgggaggtcaggatgggaggatcccttgaagacaggagttcgagactagcctgggaaataaagtaagacccagtctctaccaaaaaaaaaaaaaaaaaaaaaattaaaaattagcatctccagtcccagctacgagaaagactgaggcagaaggatcacttgagctcaagtgtttcaatgctgcagtgagctatgatcgtgccactgcaccctagcctgggcagcacagcaagatctcatctctaaaaaaacagtcataaaaaaagaaattatgaaagggacaagattgagattattttcatattcaacatatattaagctaatattatttccagatgatttttatttctctgacctcttccagaacatgaactcccaacacacaggaacgtaggagtttatcaaaatgcttccaaagacacagattgtaaaaagagagaatacaatgttgcttgatacaaatataacacaatctacacatgtaatttaaagttttcccattgccacttaaaaaataaataaataaataaaggcaggaagatggcttgaggcccagagtttgaaaccagcctgggcaatacagtgaggcactgtttcagcaaaaaaattttaaacttagctggcacatgtcgtggcacatgcctgtagtcctagctactcaggagaccaaggcaggaggattgcttaagcccaagaggttgaaggctgcagtgagctctgatcacaccactgcactctggtatgggcaacagagcaagaacctatcacttaaaaaaaaaaaaaaaaatctactgtatggtagacgaacctgtgtatggtagacacacctgacagtgataacttaagcatacctgcgaatgaccctgtatggcagatgcacctgaatgtgcatttagagttccaagctaaggaatccaggagaggccaacccggagatccattccttaactatgaggaacatccaagtctttaccctctctcactcccatcctgtcccgtggaacaggcaggggccatacaggggatcgaggctctttgtttcgggttgaacgaaggttgccaggtggagactgttagaggagggtgctaagtaaaaatgctacataaactgcatgccttctgcaagcagttgcagttcttctgcccagcctgctgccattggcctgtgcagttaccctgtccagcctgctgccactggattcttccccgtatataaggcccagaaacaccccatgtcttgtttgctggctctgggtctcttctttggcctcttgaatctggtgccatccccactggagtcaataggagtttggcacaacagatactggtgacattaacataatattttatttaatataccaaaaatagttccactttgtagtgaatattaaaaattgagatatgttatattcttgtactcatatacttttttttttcctgtagagatgaggtcttaccatgttgcccaggctggtttcaaactcctgggctcaagtgatctacctgcctcaacctcctaaagtgctggaattacaggtgtgagctaccatgcccggccctcatactgtctttaaaatttgatacatggccaggcatggtggctcacgcctgtaatcccagcactctgggaggccgaggtgggtggatcacctgaggtcaggagtttacaaccagcccggccaacatgatgaaaccccgtctctattaaaatacaaaaaaattaactgggtgtggtggtgggcactgtaatcccagctactcgggaggctgaggcaagagaatctcttgaacctgggaggcggaggttgcagtgagccgagatcgcaccattgcactccagcctggacaacaagagtgaaactccatctcaaaaaaaaaaaaaaaaaaggtacatacactggacagtggctcacgcctgtaattccagcactttcggaggtggaagcagatagatcacttgggcccaggagttcaagactagcctgggcaacagaacaataacttgcctctacaaaaaataaacaatattagccaagtgtggtagtgcacacctatagtcctagctactcaggaggcttaggtgggaggatccctcaagcccaggagctcaaggctacaataaactgagatcacatgactgcactcccatctggacaacgcagcaagatcttatctcaaaaataaaacaaaataaaagttggtacatattttacacctatagcacatctcaattcagatgctaaattttcatttgactacttgacttgtatctagagtccaaaaaaactttacagttgaaaaggtagattcacatacccaagttgctctaaacatatttacaattttccattaattgaatcaagcctcttgtttaagtttaaaattaaatgaaatttagaattcaattctctaatctaaccacatttcaagtactcaacagtcaaatttgcctagtgactgccatattggacagcatatgtctaacaggaacaggaaaaagcatctatctcatcagttggctctatcttctccagttctctgacattgcgtttatgatggctctcgtagtatctaactggtacaggctgagattaacctcctccgcaaggaagacatttttgttctctgaaaagccatcagcatttggagtctgaacaatggtaaatgaaaatattttaagttttccaggggggtgctaaatacagattacatttgacatcccattggagtacatacagtaaatggattttaattgtaataattaattattggaaacaccaagggtaaaacctgcttaccctaattatgtgaaattgttctaaaatccatttggaatggccctgttaagagtaagattgaagaaaagtcatcccctgtcccaggtgtaatctcttctgcgggctctgggcagcaggctgataaaaaggcagcaaggagctgcaaaaagaataaactactcacctgaatgcctttgaaagactgatgggcaatatttgttgggaatttgaatattctcaaacttaccaaaacacatattttgctcaaagattttttttttttttccaaacagggtctcactgtgtcagccaggctagagtgcagtggcaccatcactgcatcctcgacctcccccggctcagctgatcctcccacttttgcctcccaagtagctaggactacagccatgcatctccatacccggctaattttagtattttttgtagagagggggtttcaccatgttgcccaggtgggtcccgaactcctgggctcaagcaatccacacacccgggcctgccaaagtgctggggttacaggcattagccatcacgccctgcctcaaagatattaacaaaaataacaataataataaaatgaggcattaggaatagtgccttcatttgacaaggcacaggccactcaaatcactgattaaattataagattccttggcaacatcagaatgagaaaagccaagtagctataatttgtgtgagccaaaacactggacacaaagataaaaatgacatcaggctttgctttctctacaaagaaacaccaacaattgttggtaacaatctctgttaccaacccagcatggtttataacaacaacaacgactaactcaaatagttcctactaataatattagtagtaataataatagctaacacatatatgccatttactccgtgccaggaactgtcctaagcattttacgtagttaactcgtttaatctgcccaacaactctagaaagcaggtactttatgcgacccattctgaagatgaagaaagtatggaaatgacagttaatgaacaaaggtcacacaggcgactggcggaagacctaaggtttgaacctaaacagtctggctccaaatggcatgcttttaaccactacgctgtacagccaagactatcaaattcaccttggctggtctgagaattataaagaccactacctactcagaccttttaatcccaccctgacagaaatacaaatacatgaaaacttctttccacatttactcaccaaagatctttgcgcagtgatccattcactgtgaccaccatctctcttcttagcacatgcgtgcagaaaatctagttccaaaatggagtcaatccaaccaaattaggaaattcctattctactcccctctgcacctcaagaatttcatacaactgaatgttgatctcaacagaaatcttgtggctcatcactcatctacaagaactgctaactaaggaattgcttctaatatcatgaactccaaacccacttcaataatgggggcatggacacacgcattaaaatctcacctacaattcaaaaactcacaatcccatcttagacaatagttctaatcccacgtaacaaggttgataatgaattgccaactatttctagtttctctactcttacttgccccaaaagctcaaagcacttcatgagagaagtgacttacaaataataatgacagaagcacccaagtaaaaggggaaaagtaaggacccagatacacagcccttccttcatcagagatgtgtatttcaccctggctttccaccctattgttcttattgtatgattccctcttttcttgcacttggatttcttccttggtgccattcgtttcactgtgtgtgtgtgttgttgttttttatttttgagacaggtcttgctttgtcacccaggctggaatgcagtggcacaatcacagctcaccataacctcggcctcccagactcaagtgatcctcccaccccacgagtaactgggaccacaagcacacaccaccaccacatgactaaatttttttttatagacagagtctcactatgttgcccaggctagtcttgaacttcctcggcctctttaaaatgttgggattacaggcatgagccactgtgcccagctgtgtgtattttttaatatgataaagcttgtttaatatgttacaaagtcttatttattttatttatttagttttttaagagacagggtctcactctgttgtccaggctggactgcagtggcatgatcatagctcactataactacaacctcctgggctcaagcaatcctcccacctcagcttcccaagtagctaggactacaggcatgtgccatcatgcccagctaaatttttttcatttttttcttggtagaaatggggtctcactacattaaccaggctagtctcaaactcctggcctcaagtaatcctcccaccttagccttccaaagactgggattacaggcgtgggccacagcacccagccacaaagttttctttaaatggccaattcggctgaggaaaaaaatactcatcgtgaaaatcaagtaggtcaatatgttggctaaaatttccaattgcctttagcagccagcagatatgaaagtaaaaggaacaatcccaatccttgagtttatttttaggctccccaagaaagaataataacatacctggtttaatttctcaagtactcctatatttgataactcactgagctgctttttgtggcctctgtgactctttaatccaatgcattccacaaagcaaagatcactttaaagcactctccccaccccatcctctttctcacaaaaggtgatgtttcattttcccaacttccttttggtaaattattacatggacctgctttccctgggaaaagtccagaagcatatcttctaatttaaggaatgtaccaaacattttgagtcctacagacccttctgattggtcatgaatgtaacaatcagcctttctcctgtgacacttttaattcaaaaacaaacccaaggcaaccttcaaagctgaaagtgctgaaattccagaatcagaaaagaaaaaaaaacttgctcattgatcaaggtgacacagtgcatgacttcagtatttaatagagtgctaactactgtatacttaaatcaacttccataaattcccaatgatgatacaaaccatttacctggaggccccaaaacataaaatctatgacagactttgatattaatttttattgaacattaacattacaccctatagacatgaacatattacctacgatttatgcagcagtagacttttgtaacctcacgaaattcatgttgttaagtcttcattcaacccccatccccctacgtgcacaaacaaatacacaaacctgctctgataaaatcaacaattacacttgcttccctctctgagttgccaagtcatcagatccacccacccggatccctttatgactgtaaagtttatggattacttatttctcacgggttttgcttcctgacatactgtaaccactttccttttataaagctctgatcaattctcagaagcatattggcagaggacagtgagcaacagtagcaaagatgtttttaggattttattacttggagtcttgtttgcaaagaactttacactcacatcagagccttcttacactttagaaatggaagcattcgtaatcctatttaacacacaccaaaaataaggttaagtcacttgcaaaagaccacccagtagatacaaggtagagttcaggtgcaaggtagcaagtgttccatctacccttttaatttcctcagccaccaaaattcaagtttttgttttttaattaaggctgacatcactcgtgtgagcagaatcagctcatcacatgcggcaccactagcagctagactctagctgctagaacatctccttcccagtttgttgttgttatcgttgttgttgttgttggggcagaatagacggtttgagagcagaagaggcgagaacagaacctatgagcccagtgataggtgtgataataaagacgagttttgagtttctgataagcagtttatttttaaggacccaaaataatctaccttgacattcctcccaagtaatacattcatgtttttcttgataacaatataactgttatccaaataaaccttagatttacttaggaaatagttttaatagaaagtttaagaagtcaaatataagactagtattaccatataaaaatcccacgtagaatctactttttctcatcaggcaaggtcccaaataaaaaaccactttcagtaatgagccttgtaaaggtacaacctaaatgttttttatatgcttatcaaaaagttgcaaggtaaaaaaataaaatttttgtctcatgaaaattcaaaaccacatacaaaatttgtatttttctaattaagactttccctacattggacatccagaaagtactacagaacatatgagaatctgatcttttattatgagtaataggtgtttcttcttcaccaccagaggtcagaatccagaattaagtccttatttttctaaagtattaaagttttatactttaacctcatgaatcttggagcaactttaaaagccacttaaaacaaaacaaaaaagccctcatttctcgacactaaatgtaactgtagaaaacagtttcacaaaggaagaagagagggcagacattctggttatttcttcccccaaaatactctagaagagcttatatgcatatccacaaggaggtaatagttgttgagtcggcctcacatttattcgcagattcaacaaaggacagctgacaagcatgtgccaggcatggtgttaggtgcccaggacatgagagaaaaaaaatccctccactcatggagaaatctgacctcaattccatctgacctcaattcatctgtaacactcattcaacaaacacactgaacacctcctagagccagcatgtttggaatgaacgatttgtctatataagatcctgctcattatcttgcctttctactgaaatagagtttatcccatgcctatgacagaaaattcatctctaaatattattctactattcactggacttcccccaaaaggctggtcaaattacttgaccttttagacattcttatcttacagatctagaagacaggaaacaacaggagcttgaatatgtaactaagtttttataactacattagaaactttccttgcctgtacaagacaaaaaataaacagcttttttttttttaatttacaattcacaaaaatagacaatcacaaccctcctggcaaaagaaaatgttcccagaatactaaatactaatttgaggaaaacttcacatactaaaatcacaaatctctgagtcaggtatttctctttagagaaaagcaaatcaattgtaatggtccagcagcttttcatacccttgataatgactagtttcttccacataagaattttccttttcctctctgttcagttccaaatactgtttgttcaaactgaatcaatttcatatttaggatttttaactggatcacactttctgcctaacatttttcatataacccctcattaaagagacattaacaatttcaatcaaaccaattccacttccttacccaaaaacttaatttcctgtacagtactgctttcatttcacctttaaaaaaatctcagttcacaattttttaaagacctctgttctctattacttaagaaaattcatagtctggcagaatatgcaccaatacaggttgttacaagtttggctactcagtttctgatggatcttctggtacataaaaccaaattacatattcaagctcctgtccctacttaaaattcatttttaaaattactgaacaccaaaaatggatgacatgaacaaaatatactcacagaatgttacaacagtccatataagatgcaataagaaagaaaatcaatgaaacaatattataaattgcacaaaactctcaataaaacaaagttcagcaaaacaaagctgattatatatactttaaacttttaactgacttcacttacctctcaatctgacaaggatacctactttccctctgtaaaatacatgggtgacaccctccaaagagcaaatgtatatagctattaagtacctctcccataatatacttagtacaaggcatcttgtttgttccgaaacctggctttttgcttttgttcttgaccatttgctcttgtacttaagtaatttattattttgttaaccaataaaatgagggtgaaaaatgactacttttgaaaaactaaattaactactttgcagatactcaaacggaagtggctaaattaataactgcctaatgaacggtggaaagagaatttaagtctgtaagaaacaataattttaatcttaattttaattattcctttctaattaattaactacaactagaccaagtagtcagctggtgtcgaattaagaagtgtttcgtgaagctaaacaaatatgataaagcatatggtggtggccactcccaatcatccccttccccagggtggccagacgagtcttcagatagcactcctcctgaaggtcatctaactgaccccacaaatcatcttaacctaatcttacactggattctctggtttattttcatgccggaaatagcattttggttgaaaacacagtttcctctgtaagtattagcctccaacctaaatttttagagctgaaactgagttctatttttttttaatagagacagcgtctcaccatgttgcccagggtggtcttgaactcctgggttcaaacagttctcccacccaaagtcctaggattacaggcgtgagccaccagacccaggctgcaactgagttcttgaacccataaagctgagaaaacataaaacttaaaatctcactactctactacattctacactgatggtctttaaaccgggctatgtataacatttagggcacatgaaaactctaaaggaaaacaactatctctccatcttcaacttccttgtaaaataatatgcctgagaatttcccttctctttcctaactgcctctcacttcctaaagtgggcatacctctcagccaccaccctcccctcatctcactaggcacactgcccacgattataaaacctcccaggcaacaaggaggagacccactagaagcaaactggtcttgatgcaaataaataaataagaaacatttctagacgtctaaaagggaacaaaatgcttttgcaagttggattgcttcaaacaaaattacaggagcatccattctttaagccatctgccaacaaatcattaaaaataagttctgatgagattactgtgtgagttttgccatataacttcagaaaaactccaaacaattgactggcactgctataatactccctttttcatttttgacaagttttttcagtgcctgcatcttacacagaaaagaaaaagggaaaataaaaatgatgccaaatcttttctcatctagtaataaacgaatttataaagaataaaacacctgtatatatgcaatagatgaatgtataaacagaaatatttttattttttatcaatcatttatcagaatttgtaatataatcatgttattttgatcaactccattccacaaatggaaatatttatacaattacttctggattaaataatccttgaggcataggatatttttaattttcagtattgatatatttttattacataagtatgacatgataatccataaaagactctaaaacatgaacatgtattatattagaataaaaagtgggggagaaggccaggcgcagtggctcaaacctgtaatctcggcactttgagaggccgaggtgggcggatcacaaggtaaggagttcgagaccagcctggccaacaaggtgaaaccccatctctactaaaaacataaaaattagccagccgtggtggcgggcacctgtaatcccagctactcaggaggctgagccagaaaaatcccttgaacccaagagtaggaggttgcagtgatccgagatcgcaccactgcactccagcctgggcgaaagagcaaaactccatctcaaaataaataaataaataaataaaagttgggggagaaataagataacaaaagagttcaagtaaacagggagagataagtttccaattaaagagcttgttcactgatttttttaatgaatggtggctggtatgacaatgttagatttttcatcagctctacttaagtatattatgtaaaaggcctatttttaaaagccaatttttacaatatgccccaaattacgtattttgaaacaacctaagttataatgacaacgtatgcaatcagcacaagatttgaagaccatggagctataccagtagcagtcggtctgcactcaatgactacgattcagaagaagaacgcaacctactgttccagtctttaactaacaacagctcctcggtttgcacctgcagttggagtctcaggaacatcatttcctccacaagctttgcactttcccacctcctggcccctgttcataccaccaagaaaacagacccagtcctcctcaaattccaccattcttccttaagcaggggcttttggtcaggtgctgtgaactgctaatttggtaggagagcagaataacatagtggggtagtggggttgagggcatggaatgtggtagcaggttacctggtttcaaaatctgcctctacaatttactagtttaagccaattaatctctctgtggtccaatttcctcatctttaaaatgggaattataatcaacattacctgatgggggtgttgtaaactgaatgaattaatatagctaaaacctttaaagccctgcttgacagtttttgccacatcatcgttattgcccccaccaaaatttctactacagtgactatcaccacacctggtccagatttttactgtgtagacactagcccacatctttataaattgctacttcctcacctatttcagggcactgcttacttgcaagaaacaaacaagaatatctatgaaccccattagtcccttcctagagaaaggcactagtgagaatataatacggtccataaaaactctgtgtaaatcaactggggttaaggaagagaaacactagcaaaggtattttaattagcgagtaattctaccctgtttcagaaacagaaaaatctagtggcaaaaagtaccgggagagggcaagtcctgggaagaaactgctgggagaaggtcacactttctattcccagggcttcattcattccttatcttgaatcaagagacaatacatggaaaataattagagggggataacctatattgataaccaaagaaaaccaaaaaataactggatagacgattgatacagacatcactgcctattcctctcctctccagttgttcaggcctacagttggctgtagttcactttttacagttggttgaaaacagaaaaagaggctgcaagaaggaagccaaggacagtactaaacagcagctctggagaacatgggctggcaggtgtatgaacacagaaccattgatttcagcgaccactacaacaaccatccccaaaatcatatcttcaggaaagaatgtttctttttaacaaatgatttgccctaataaacgcagccccatatttggccttcagaagcaattattttttgtttttgtttttgttttggtagagacagggtttcaccatgttggccaggctgatctcaagtgcctaacctcaagtgatctgcctgcctgcctgcctcagcctcccaaagtgctgtgattacagacgtgagccactgcacccaaccaggaagcatctttccaacccgaactgcaatataactttttcattgcaataaacctaaacctcacttgtgcctaaatgcaagccagcatcacatcctcagctgccaagttgaagaataggctcttatcaattcaacagcacccaaaagcattaaactcagctgagatatttgtgtgaaatacagattcctggacccctagagaggctgactcagtctggggtagagatcaagaatctgcatttttaaacaaacccccagggaattcttaagtacactgtagttttatgaccactgcctgaaggacatccctggaatatcacttagcaaatgcaattcatacttactttgcccactatgagaaactgttggcatcatttgcatcagcaagctctgtttccacaagactgggaccatgactacaaactgtttcggatttgaaacttgccagcattacaaacagaaaggaaggggagagcatctttctcatagcttagtcacagtcctggtgaagggtctgaatcaccctgacggctgcttgtctttttcactaaaaggctgaatgatgagggtagactgtagcacaatggttgttttatcctgttccaggtccacctttatggcccaggaaccctgtagcaggaaaatggggcttcatgggatatggtctctcgggaatcattcactgagcagttttgctaatttgtttttactaaaaataattttatataaaagtaaagttatactttataatacgattccattttaaaatactgatataagtattttggaatatttgtgttcctaaagagagcaaaggatactcctttgcaaaacatatgtatgagtacttttaaaagctgagacacttttaacttttgctattaaaaggaaacataaaataaacaaagcttttgttaactggttaaagtaagtggtgttcaagttgccattccagtttccaagctgtttttgtgaaagcagaggggtgggggcattttacaccagtgcaaagggtaagaatagcactccggaagaataaaacttctctttattttggcactccacattaacttatctgataagttgctgagtttattatatggggatatttatttcaaagccaatgccttttgcaggggtaggcagaggcatggtgaccaattttactatggcagagcctttggccaaatcacttcacccctttgaaatgcatcacatggcatcctttaatttgagtgcctcctccacctgagtcatgtaggataaattactctgtgctgtcaaatgttgtgtacctgttatcaccactgcctgagagagcataaaatacatattttatggaatagtcactcctgaatgttcaatatgcacaacatagttttggtaaaaagaaagactgactttctgacaaatacaaggattttgtagcagcaagagtactaacacagaagcaagtgactatgttcttaaccctacgtaaacacaaaccagactagtcattttactttgggcaacaccagatacattctctgtgccactggtttcttcagatataaaataagggagacttggataacatgattcctaaaagctcacactataaacctgtacttttcaagcagtctcaggtgttgttttctgtaccaacaaaaatgaaacatattgtgaagttgacatagaaattcattactgtctgcttattcctgctgagggttctggaattataagcctgggaaatagcaaaataatagctgccatgcataagttaaagtgaagaaaaaaaaatcagaaataacatctggatacccagacaccagatcccttcaatacatgcaaacagaaggtatgtagtcatttttaaaagaaggaggcaaaaagccacaactactattttgaaagatgatgtatacgaaaattagcaaaagaaaacatattatatcttacatactaaataagcatgatttataccaactatactgtcattcattcaacacatatttactgagcacccattatgagccatgagttggggaaaagagcaaaaacaagacaaacagttcctgctctttggagctagataaacagcaagggagtaagccaaaattaaagaatttttacaaacgtgatgttgatgcacaaaagaagtagatatagggtgtgcccgaaaacctaatagtagaagaagctgggtgtgaaggtcctcagggaataacatttcatctaagattttaaggattgtgggcggggagcattgtgggctaacaggagacagcattctatgcagagaggatagccttacactcttattaaaaaattttttattctatttttattatttttctttcattgatacataatattttacatatttatggggtacatgtgagtattttttacacatacagattgtgtaacaatcaagtcagggaatttggggtgtcatcaccttgcatgcttatcatttctacgtattggtaacatttcaaatcctctcttctagctacctcgaaatatttgaaatattagacactatcaaatgttatatctataaattgagacagtttagataatttaggtatactgttaaatgttataactgaaaagcaaagggaccagggaacatgtatctactttattttgtgtgtgtgtgtgctgcctcctgtacttttctccaggttacacatgcatgcacgcacacacacgcgtgtgtgcacaagcacatgcattttatttctctagttaacatgtatctactttagatcaatggagcactgtattaaaaattatatacactgagaccagcaggacagagcactatatatatagacaaaaaatgagggaaatcattggcacacttacatttttttctcattttaaaaatagcaatcaagatactcaaactcttcattctgaagactatccccaaaataattaatcccaaaataaattcgtgtaattaaaacttttctgattaagaaaaaactccaatcttttccagagaccacctgggcagcctcagaactattatccttctatgctaatgattgctggttttaatcatcgtccttatagcaaaagacaatcattgcattccagttgacaatctgtgtccaagtttcctttccaaagttgtctttaaagtccaaggcaaataaaaaccaccacacatggttgcttacagaactgacaagagatccttgactccaacagacctggttggcatcaatgattcaagcacattatgaaaatctccacacgactcaaagttttttaagtacagaactgaagtttacatccacaaatctgtttgatctctgcagttgcaaaaccatatggcacacagagaaaaacaaattatctctgcttatgaaataagaaccctctgtaggctttgggacagaccaacagctatgattgtcctactcgctgcgtatcactataattaactttctctgatccttttgaagaatgtagagttttggggttttggtttgtttgggtttgaggggtgggggggcagagattagggaacagaagtaaggacatcaccaaggggagatggagagaatcctaagcctaacctcagacacaataatttaaatattatctttctataaatattttatgtcatattttcatgctttatttaatcccatttatactgaggagatatataaagccatgcatgtcaacatttaccatgtaatgcaagttatgcttgtgaaaagggctattatactaagtgactcagtagcttccatagtaatactagtttcacaatcactataagtttccagccattggctacacagaaccaaaagcaaaaatataccatgacagtaattaaaaatgcggttgaattctgctatcgctgtttccactcccaccactacctctaccaccaccatcattcatgcaatcctcaccaaaaaaaaaagtttagaaataatttacacttctagctttgcacctcaaaagtaacatgtaaaggaatttaaaatttgatctatgacactaacagattttaataaactacttcataaatataaacaacccaccaatggacccttagcaccagcaaagataatttcagagacaatttggttaagcaaattcaaaagtgtaataaaagaaactgcaaatgcaaaaaaagagtgacaagaaaaaaaggagtaaatatgtttaatggcagaagaatcatttcccagatacatgtgcaattttatacattaagtgtttttaggggatgaccaggtagaaataatttatcattttgatttcctaagagaagacactattcttaagaataagaggctcagtagccctgcctatctttctgcctggtaagaccagaaaaatgaaagtgtttccctaatactttgtgtagtataacaggtgatacagtagttaagactggcttcaagtcttaactaatcagagttgtgaaatctcaaaaacactaggtcccagagcattctttgcattttgtctttattttacttatactgtacccaatgaaacaccttctaggaacacctaccgtcccccattcccatccagtcacagctcacagccctgctggcttgctagcttagatctcataaacctggagctaagagctaagaagcacagtaacctatcagagctgtcagacatgctggggaaagtttccaagaagcacactaggcagaattcaaaggaaaaaatttatccctgaagctctgatcaactccagacataaatatctttaaaacatatggattacaagcacagtcctgggaaaatcagtaacatgtcgtggaggaacaacattaatgggtttacctggaatctgatctgctaatatctaaaacacttttttttttaaagatcacttgctataacaggtgaactaagaataccttttattcactatctaatcttaccgtcctaaagccaggtccctgctgggtagggaggggtgtcatatatttgacaaataataattgaaacagccttttccttttctttttgttgacagtctattcagacaaaccaggctaaatacatttccagattcccttatgtgcacaaggagagaacagctccataaaggtccacagagacatctggaacaagcagcatctctacctgctaagcataaatactgcttttctgccttcctggatggtgcttttaatttctcttacaatcctaaagcctctcagctgggttagaaagcccattgtttttttccctttatccttcagtgaaggccttgtctatacctcttggccacagacagacagaacaaagagtagtcagacctacagatttctgtacttgaccttctttatgtgggaaagacgttggcgtccaacactgctataataagaaaaaggaaagtgagttgcaggaatgacaaacagaatctgtaaaagaagaaaaagaatcagccacaagttttcattatccaacttaggatataacaaaagatgacttttaaaaataaataaataagcaagtgaatctagtcaggatagaaatccatttggcaagtaaaatccatctccagcacagcatttttagagcagcatgctggagttttcatgttttgaaaaatgagacactgactaatacacttagccaaatattctaatctgtcatcattctaaatatacgggcctatctttcagcaaacaaattagcaggtaatatatcatccctgagtgcatacccttccctggatgctctataaatacagagtgatcaagactggcagttactcagtgtaaaatgtaaaacactactaacttcacttaagccacactgcagaagtccatcatatcaatcagaagcagggtgtcagaaaagtttcatgcacttgaaattcttccaggggagggaaaatgaggagacttagaaaagagatggctcttacactccctttatttgatcatggagaaaagaagaatgaatctctggaaataaatgactcctgtatgtttttaagtgtgtctaggatcagatgagcaagcctcgaatttggcaaaattgcaaactaaaagaaaaaatagcctttgcgttctccagcctcacctactaaaagtaattcaaagtacataagcttcccaatacagtaaaagctgcaaagctagctatagtctcaggtcctcagaaacaactcatgcattttccaagattctgatttaaacaacaaccaactattttctgagggcaaaaggggagtaaagttcttaaatcatttaattctgccaattagttccgcaactatggcattaaagaactatggatatttatccactggaagtggatcaaaaagtgggctctcttaatgcctattaaatagtgctgattttcaagcatcactgaccaaggtcaaatctgaaccaatgtgaaaacctccacttccccatcactaatcccttgagccatccattcttccacaaggcaaatgttttgtagtcaggggagaaataccacacggtatgggtagcacttaatatgactggtttctacattaaactcagcttacacgtcttccatttatctgtaaaaagttagagaattaaaacacactggaatctttcaaatatgatatcactatagtactggcatatacagagaatcaaggaattaactgctttattccacatatattaggtaaaatctctggtttactgactgatatgttttttttttttctcagtatttagttttctcccaccaattggaggaataaaaggatgccccactgagtatttgtttacaattgacaagattatcttctgtaagtgtgttactgatcaaactgtacaatgcacaaagcttcggttccgctaggttatcagctacacttagaacagtttgggctaaggagttgggagggatgaggaaaacacagtgagctgtaatgcaactgtgctcttggtggggtgcgcacactgcgaataacttaccaactcactgcccaaaaaggaaaacttctagagtagcccagtggacccaaggacctaattgttcactttctttatagaaccactgctataagtactgtcctccccactctcataatctaatacacactgctaggtaattcaacttaatattcccattgaaacaaagttagtcacagtccaagtctacagttatctataccatgagtttttaaaacatgcccaggttcactgaaaacctaaccacgaattacggtaccttttcaaaaatattaaatatattgaaactaatatattccaaatccccaaagaaaatatgattgcattttacctctccacccccaaggaaagaaaagctgtggtgccctgagacctagactagataagctagtcactaccaaaaccctgaacataaaaagctactctgtccatcgtgggcacattctagtccctcttcagaaaaagtccactctctatatcctcacttcctccttcctcctactcaaggaaaaaatatatatatatttatatatatatatatttatatatatatatatttatatatatatatttatatatatatatatttatttatatatttatttatatatatatttttatatatatttatttatatttatttatttatatatatatttatatatatatttgtgtatatatatatataaatatatatataaagtgtactttcatcacatggaattaaccactttcccactgtatttttaaacactttttgggctgagcatagtggctcatgcctgtaatcccagcactttgggaggctgaggcaggtggatcacttgaggtcaggagtttgagaccaccctggccaacatggtgaaacccagtttctaccaagtctacagagtgagactccatctcaaaaaaaagaagaggggatgtgaaggacccttctgccccctaacaaaataaacacttattgtacctatcacaatgcatgttctttttaattgcatgaacaatacacgcttaggacaagttcaaacaatacgtaggcatattcagttaaaacagagtcctctcctctccctccaatccctgctaaccatttgttatgtatccttccagcctgatttatatacttaaacacgtatacatgcttatcagtttacagatctagcatatctaacagactgtgcactctataagagcaagaaatgccctattcacctgtgcatccagtacctggcaccctgctgatacaaatagttgctcaataaatatttactcaagaaataatcaaacggttaaagccacagagaagcaggtcttctggggacttcagaaacaaggagaaacacatgtctgtgtccttacatatgcttgtgcccatgctcatctgagattaagaaggaggaaaaagggtagagggcatctgaacctagggctccaggtggtacaccaaatgatcactggttagccagcacaaggatacggaggaatagcagcatatccatctttaaaaaataataataatactcaaagcaactgaccaaagagggagatccattaggattctgctatgtccctgatctcaagggcagtcttattaactgtcttaaaggcaccgtccagcaaccgcatataggattctcagggtatcaacctcagaatagatcatttatggattagaaagtgggtctgaattgtgtttgaatatttataactcattttagaaaaaatgcagaaacttcaggatgcaaccaaaagcacaagaggaaatgttatcactcaaagtcaaaaaaaaaaaaaaaaagtagggctgaaaaaattaaaattaggctgggtcccttttctccaagaatctaaattaaacgtgtttctataaccaaaagaagagctgaaagtagtactatattcagtaaaaaaaaaaaaaaaaaaaaaaaacacaaacgatttaaccaattaatatgcaactcaatatagaagtataaattctttaacttttttaaaaggttattagccttgctgttgcaatcaagccaccaactgatagccaccccaagctatagtgagcctaaacataaaatggcacaggaaactcttctatgtcaaactctgttttagtaaatcttcagatttgaacattgaaatttcatttaatttggcttatcatcacagttctccttttccttgccagggttccaagaaagcgtaactgcaagatttggcacaagaaactttccacaacttggtcaacagccctgactatattatcattacccagatttatagaatggtcccagtgaccaagacacagggtacatgtccaacaataatgtatattttgaaatgaacaaattgatttatacattaaccaaacaggtttttggctcagagtcaagaagggctacatacactaacacttggcttctaaccctgaaactaacaggtcttcattccactggggagcaaggggtttaaaaaagagaaaggcccatgtttcaagaactcttctctcttaccctccaccccactcaccaaaatacttacctccatccccgccacctacagctgccttcaggaacaattaagatgttgacttggagtccatgttctgtggctattcaataattcccaattaataaaccttagttaagaagaatatggtgacagaaataagtactcataaataaagtaaaagaggggtgtgtgtatgtgtgttagaaactgtgatacgtaacattttaaaagcatccgccactgagatatttatagattaaaagatttgatgtctaggactgacttcaaaataaattcagtcggagagagggaggaaaggaggcttagatggtggtattgatgacacaagattgtgagttaataattattgaggctgagtactgaatacacagagaattatactattctctctacttttctgaatatttttaaatttccataatacaaggctggggaggaaggactgaaaacttaaaataaaatgctaatacctcttaatggagggattatggataattttattcagtatgctttttgacaagaatcatattactttatgttcagaaaatatttataactagcataatgattctacaaaatacttctggatgcctttagaagccattctaatacaagcaaaccaagctgtagcaagatccaagcttaagagaaaactacagtcccctgaggggtacacacccaaaaatccatataaacaaagtttccagtgaggatgtaacaagtatagaatgaaaagaatctgacaaaaatatcccaacagaaagtaagacaagttaatttcttttcctgaaggaaaatatcatctgtttaacaaggtttatttcccctttcagctaatgttgattaagtccttgttatgtacaaaaaacttgtctgtatttacatctaatcctcactacagtcctgagaggaagttattaccttcatttcagaaataaagacattgaggttgagagagtaaaaatagagtggggttggagtagggattccaagaatttaagaatcacatctttgtctttaagatgtctcagagaaaaaaaataggagagaaaattcccaaacacaaagataataattcatctacttcaaaaaattcccaaaggaaaactatccagagcctcaggttccaacgtaaccctatgtgagggtaacacttacacccctcctgtccatgctcacgaccaaggggaacaaatgattgtaaaaggaatacatcaagaagaatgaaaagttccataagcctcaataagatcaacaacagcagccagcatttacagaatgcttacttatgtgcctcccatggtcttattcacatacacactaaaggaactcttatcgttcccattttataaaaactgagactcggagaaaccaggtaacctgctccagatacctgctagtaggcaaaaactgttttcgagacccagaaagcctccatgggttactgcacacaccattacccaatgttgtaccttgaaatctaggctcattccctctttaaaaacagttatagcaataatagcaatcatctatctacactccccaattaacaccccacaaaacagtcaccaagatgtcccaagacttttcaaagtctcagagctgttagaaagactacacagaaatctactacaacatacttataatatgcttgatatttcaaaaagtacacaagccaatgacgacaacctataataaaacttcagcaaacaagcactagggaaaactcagcggtgtccttggtatttagaacacccagttctaaaggtttggagtgaagagaccattccaaatcccagtttctccactcacaagttctatgactttgggcacgtcatctcttagctatttcagtccctgtttagtggagctaacatacctatgtatacgtaaagctcagtgcttgacactcaatgtgaagcagaagctcagtaaagtcttcttccccacctaatgcgctgtggtctgtacctgcaaacatcctttctcctccaataaccctagcagaaaaatgaaccgttggctcctcatttgcccccagctggcccaaactacattccctccactctgacaacacaacagcatctattctataaatgaaagatcctcaaactgtggggatttagctcagtaacgctattttgcaattactataattttactttattggactttcagatgggctttgtttggcatttgattatttcagagccaatttcccacttaaaattctagaccttggctttgaaaatagagtatgaaaaatgccaggatattatattgtaagggacaaaaactgcatgagcagccagagattgttttatttatacagtgacaacagtcagaattccaaagaatcaagtcatagaatcttaattttcttccgtcagcattactagcatggtagtaataaacaacaacagcagagtcaaagtactgtgttttttcaaggttattcactaacacttaagagaaatgaaactaaaattaatatggctaaacataaacactacactttctaacaaacatggaaattatttctcctacatgtatcacagttttaacaatttcttaagctacttacatcaaactatttttgtttaaatgagatttctggaatgtctataacaacaaaacagatttagacatatgtacatttatgacatgagtagaaaatgaattgtgaaccttaccaatttttgtatttgtcagaaccaaacatttaagcaaaatcaaaaatccaaaggtccaacttttatgaacactgttaaacgattaactttcaaattacttagaaattctggaaattcctagcaataccgattgttcttctttaaaaagcaacccaataaaataagaaacctataggtctggattaagtcccaacaaattccatattttcttactttttttgactctaacttcccacttagaaaaggcagggttaagaactaaatagattctgacctttaagcataacttgaaaaagccatagcctgaagatgagtcatacctagactttgtaaactaactacacaattgctaaactgtatttcatacaaaattaagaagccatgagtaaaactctaggctttatcactcactgaaaatagaagacatgtctttgtagtatagaaaagcacacagtggcttagttacacacagaaaaaaacaaggaccaccacgtgtactcacacatatacatatcattccttgggaaacaaagatttattttcatataatgctgcaggtgagcttataacttccaacaaaagcttttaactttccaacaaaaaccttttaactgcaacaaaagcaaaactacacaatgggattgcctcaaactaaacttctgcatagtgtgcacaagcacatgcacacacacacacaaacaacacagtgaagtgatgacctattaataggagaaaatatttgcaaaacctacatgtaataagagcataatatctgaaatatataagcaactcaattcaataacaataaaaaaaacctgattttatgtatttttttactatactttaagttctgggatacatgtgcagaacatgcaggtttgttacataggtatacacgtgccatggtggtttgctgcacccatcaacccatcttctacattaggtatttctcctaatgctatccctcccctagcctcccacccccagacaggccctggtgtgtgatgttccccatcccgggtccatgtgttttcattgttcaactcctacttatgagtgagaacatgcagaaaacaacctgattttaaaatgggcaaaggacctgaaaagacattctaaaagacaaaacaaatggccaacaggtatgtgaaaaaaatgctcaacatcactaatcattgtggaaatgcaaattaaaaccacaataagatatcatttcacttctgttagaacagtttttgtcaagagaacaaaagataacaagtattggcaaagatgtggagaaaaggaaatccttgcacactgttggtgggaatgtacattagtatagccattttggaaaacagtatggaagttcctcaaaacattaaaaataaaacaatcacatgatccaccaatttcacttctgggtacatatccaaaggaaatgaaatcagtatgtcaaagagacacatggatgaacctagaggacgttatgctaagtgaaataaaccagacatgaaaagacactgcataatcccacttgtatgtggaatctaaaaagtcaaactcacagaggtagagagtggaatggtggttaccaggggcagggacagaggggtggaggaatggggagatgttggccaaagggcacaaagctgcagttaaatggaaggaataagttctggagatcaaataggaagctgaccacggttaataataatatacggtatatttcaaaattgctgagagagtagatattaaatgttcttgccatctcaaaatggtatgtgaggtgttggatatgttaattagcttgatttagtcattccacaatctataaagctctcaaaatatcacattatactccaaaaatatatagtttgttatttatttatatattaatacaaaatattaggccaggcatggtggctcacgcctgtaatcccagcactttggaaggccgaggcaggcgaatcacttgaggtcagggattcgaggccagcctggccaaaatcgtgaaaccccatctctactaaaaatataaaaattagctggatgtgatggcaggcgcctgtaaccccagctgcttgggaggtggaggcggaaggattgcttgaaccctggaggcagagattgcagtgagccgagattgcaccactgcactccagcctgggcaatggagcaagactccacctcaaaaaataataatatataaataagtaaacagtaacatccagatttctcagttaattaggtctagaaacagaaaatttctgaactacctttttattagttgaaagaaaactaaaattagaaaacctctccttgctcaaagatgtgttttctccatccatagatatagtttctccttcaaaaaattatacacttgcatataaaatgaagtacctccagattactgactaggagacttaatgaaatcatttggtttattcacctgttgatactttcatatctcccaccaagtttgaaaactaggtcaaagtaaaactatcacaacaggagaactttttttttttttcgctgttgtgttttgtttttgttcctgtttttgtttgtttttttttgttttgttttttttttttgagacagtctcacttggtcacccaggctgagtgtagtggcgaaattactgctcactgcaacctcaaattccagggctgaagtgatcctcctgcctcggccccacaaatagctggaactataggcacatgccactgtgcctggctaattttctgtatttttcataaagatgggtttcaccatgttgcccagactagtctcgaactcctaagctcaaggaatccacccacctcagcctcccaaagtgctgggattacaggcatgaaccactgtggccagccacgaggaagattttaaaaaccactaagacataatacaaataaaaaactaaaatggaaatgaatgaagaccagaaaagttaaagaaaatgcaaataaagttaatgtttaaagtagatgttaaaaagctttaataagttaaaagatgtctgaattataagatctgaagcaatttaagagaactaaaaccaaaccaggttgggtatacgtctccccttggtaaaatggaatcatgttgctacctccaaaaaggctttgaaaaactggaacataataaaaacagtgttaacagtaactaattattgagctgttctttgcacattacataaaccatctattgcatttaatcctcatcaaaacccaaaactataaatttttccatcttacaggtgagaaactgaggtacaagacagatcaagttacttgctcaaaaataaaattctgttgcatttttgctgtttggtttcattttttgggtttgagaaagtatagaaatagaagaactggtgactggttactcctattaaggagaatagtaaatcacttcatatcaaagttcttaaacttgaaaatcaaaatcacctatagggcttgttaaaatgcagattgccgggttctggacactacatccagggtctctgattcagtaagttcaagataatgtccaataatttgcatttctaacaagttcctaggtgataatgcccggactaactgcaaatcacaattaagagacccactgctttataccaataaaaaagaaacatgacaaacacttagagacacaataaaagaagaatgaatcatgttcaaaggaacctaattccactgtctgaattttccagttatttgatttataccacacattttaaagaacaaaagttctgtgaaaagtcactatggtgtaaagtacaatcatacctatgagatattgcaagttcattgcaaatgactgaaataaagtgaataccacaataaagaaaatcacacaattttttgggtttctgagtgaatttaagagttacatttacactataccatagtctattgagtatgcaatagcattatgtcttaaaaataatgcatagaccttaattttaaaaatgctttattgcttaaaaaaatgctaatgatcatctgggtcttctgcaagttgtatctgccacatccatcccctcattttgctagtggagggtcctgcctggatgttgatggctgctgactaatcagggtggtgggtgatgaaggttaaggtggctgtggcaacttctggaaatatgacaacaataaagtttgctgcatggattgactcttcctttcacaaaagatttctctgtagcatgtgatgccgtttgatagcattttaccacagtagaacttcattcaaagctgaagtcaattatctcaaaccctgccgtcacttgatcaaccacgttatatgtaatgttctaaatcctttgttgtcatttcaacaatgttcaaagcgtcttcaccaggaatggtttccatctcaagaaatcacttgcttggctcttccataagaagcaactcctcatctgttcaaattttatcatgagattgcagcaattcagtcacatattcaggttccacttccaattctacttctctttccaccacatttttagtgacttcctccacggaagtcttcaacctttcaaagtcatccatgagggctgggaaaaaattcttccaaactcctattcgtgttaatgttctgacctcctccaatgaatcacaaatgttcttaatagtatctagaatagtgaaccttttccagaaggtttccagtttactttacccagatccaccagagaaattactatctatggcagctatagccatagatagcaggcttgaatgtcaaaattacagatacaactcgcagaagacccagatgatcattagcaatttttttagcaataaagcatttttaaaattaaattttttaaggtttgtgcaaaatttttatttcctgtgcatttataatgtatacattcataatgaatttcttaaataacaaaacttgaatgtcaaaattactccctgacccacagactgcagaatagatgctgtgtcaccaggcataataactacagtaatttcctcgtgtatctccatcgagctcttgggtgatgaggtgcattgtcaatgagcagtaatattttgaaagaaatctttttttctgagcagtaggtctcaatagtggacttaaaatattcagtgtggcaagcagatattgtaagtagatgtgctgtcatccaggctttgttgttccatttatagagcacaggcagagtagatttagcataagtcttaaggacactaggattttcagaatgtaaacgagcactggcttcaactaaaagtcagcagctgcattagcccttaacaagaaagtaagtctgtcctttcaagcttccaagtcaagcactgacttctctctagctatgaaagtcctagataacatctttttccaatcgaaggccgtttcacctacattgaaaatctgttgtttagtgtagccaccttcctcaatgatcttagctagatcttctggataatttgctgtagcttctacatcagcacttgctgcttcaccttgcacttttatgttatgaagatggtttctttccttaaaccccataaaacaacctccaaactattcttctgcagttgcctcacctctctcagcattcagagttgaagacagttaaggccttgctctggattaggctttggcttaagagaatgctgtggctggtttgatcttctatccagaccactaaaactttctccatatcagcaataaggctatttgctatcttatcactcatgtgttcattggagtagctcttttaatttccttcaagaacttttcctgtgcattcttaacttggctaagtgtttggcacaagagatctaggttttggccatcttggcttttgacatggtcttctcactaagcttaataattctagcttttgatttcaaatgaaagatgtgtaattggcttaatttcaatattgttgtgccaggaaatagggaggtccaaggagaggaggagagatgagacaatgactggagcagtggagcagtcagaacatacacagcatatatctagttcgccatcttatatgggcacgcttcatggcaacacaaaacaattacaatagtaacatcaacgatcactgatcaccataacagatacgataataatgaaaaattctgatatactgcaagcattaccaaaaggtgacacagagacataaagtgaacacatgctgttggagaaatggagcaaatagatttgctcaatgaagggttgtggcacaaactttcaacttacgaaaacacaatatccagccagatgtggtggcacatgcctgtagtcccagctagtcaggaagctaagtcatgagaatcacctgagcccacgagtttgggaccagtctgggcaatatagtgagatctcatctcaaaaaccaaatcacactatatctgcaaagcaccatacaatgaagtatacctgtactttattttcaaaccaggagtaatcctgcaacattgtccaatgtctattatcttgacctctaaaaatcccaaaacatataactctttctacctgtctcttctaaaattatacactgttctgtgtggtgatttatcaccacacaaatttaatatatttaataactccagttaaagcaatagtaggacaacatttcaatttagtattgcttccctcctatttttaaggccctgaatgttcagatgcacaaaaaaatcatgaagtaggctagacactaacctgatatattcacgtggagttaggctctgagatctttcaaaacacaacataataaagtttgatccaggagtataaccatttgtttttatcttttcagatgatatgaatctgaagaaatgccctccagagaagaaaacacaactttcatttcacagcgcctgttctcttaacccatgtaccttttcaacatctctgtgaaattctcccagcaagacaaagagccccaggttcagcaaagattcaccttgaccatctctcactttcataccaatataccaaccacttgggcaattatcacagacttgtccattcaaatccattctagccccattactgcacaatagaagacagacttctgccagacacagccatgacagattcgaaaggtagaaataagcactgtggggtggggctgtgcttctgaataaatcctagtgtttagttttcagcttcaagggagaagagtgaacacacacaccattttgccagctaggctttagggtcttgaagtctgctgctgtgataatggaagactgctcatgtgttcagcttcctgattacagcagacatagcagttttcctggctggccagttctatattatttgggaatcattcctagaaatttaacctaaaacctgatcctccagtatcctctgtagttcccagtatcaaatctctccctgctaaaactggctaaagtggtctctgctatcaacaactgaatccagacctacatactactaaacagaaaaggattcctttaagttcctatcatttgcaaaaggaaatactccaccacaaagggaattattagtggctggcatgatagaagagatagacaacaatttggaggatctgtactacagtcagctcttctgctgaccttgactaaataagaatgtaagaactgctagataaactcaaaagaagtccatgtaagtcctcccttccctagtcatatctggcacataagatgtattaaaattttgaatcactctgaactaacatctattctaagtattatggaagcataatgaaaaacagggattgattactaatccagggctcagtttcattatctgaaaatggggctgaacgtggtggctcacacttgtaattccaagactttgggaggcagaggtgggaggactgcttaaagccaagagttcaagaccagcctggtcaacacagaaactacgtctctaaaaaaaaagaaaaagaaaaagaagagaagatgggaaacatatcaaataaagaatgacaggtcaagaacactatgatatctaatacagcaaccaccaggcatacgcaactactgagcacgtcaaatgtggctagtgcaactgaggacctgcattttaaattatattttattttaattaattaaaaattttaaaatatgatcaattactagaaaacccttgaacattatattgggaacaattcaagtatatgacgctaacattttccaagtagatattttatgaaatctaaatacataccagattccaaaggcttcaccaaaaaaagtgaaatactttattaattatttatagatatgttaagtgatattttggatatattcagttaaataaattatattgttaaaattaagtttacttgtttctttttactttttcgagtaaagctactagaaaacctaaaattgcaactgtgacttgcattatatttctattgtacagcgttgcttaccttaaggaatgtaaaacatttaacaatttttgaaagaagggttaagaacaggataaatcaagccaggtatgatagctcgtgcctgtaatcgcagctcctgtaatcccaggctgaagtgcaggaggattgcttgaggccaggagtttgagaccagcctgggcaacacagtgagactacgtctctaaacaaattaaaaattaaaatttaaaattagctgggcgtatgcttgtggtcccagctactctggaggctcaatgggaaaatcacttgagcacaggagtcaaaggctgcaatgagctttgagtagtacgccactacattccagcctgggcaacagagtaagattccatctctattaaaaagaaaaaaaaattaagaaatgagaagaaatgaaaattatatatatacaaaagaacaaaacaacttggtatcatcgagaaacaagaggaaatgtccttctacaaagagcccatgagaagacttttttaaaaacatctctccaaataagatttctaagtatccaaataatttcttcacaattctgacgcatgaataaaaaaatataaacttttaaaaaacaagaagttgatgagagccattatggaggcacacaaaattaatttcctatgagaaagtaaagtatggtatgaggaaatgtggacttgtggttagggtaaaagagctctttgctctaaccccaccctttttactcactactaagtccaaatcaagttagggacacatatgagaggctagacaggacatggtaacagcataaaggtgaggcctccagcctggtgatccacagagctcagtatgggatgcctaggtagcaaagagggagaaaccttttgttttctctagggggagagaagacactgggtgaattcagaccctaaagtagaccccaggcagatttttgtaagtaagactaattaaatctcaccagactcgtgtgaggtaaatagggagcagtgaggtcctatcccagttacactaaacaggcccattaaataaagaaagccatagcttcttaccaccttagcaagacccaagagctctggctcagctaccacagtctcacagtacaaaaagtctactcatcttagtcattcacacaggcacaaccccagccatgctaatggtcataaatgcaaatgctatccactactttactctttcttccttgggagcatttaattagcattaactcttaaaacaaaacagaaaggttaaatcccttctctccatttatggaaattaataataatttccattgctgtaactagacagtgataagagtcccatctaacactttgcatgttacgttagttaacttgacttttttttttttaagctcgatttcttagagaaaatctcttgaaaaatacccttgcacagacatgctccaacttctttcagtcttgaataaattcagactgggactcaccattggagagccaagactcttcataaaacaagttcttagactctcttggacagtttttttaatccatttgctttgagcagttttatctggaacctgtgcacactctgcctataatggttagtcctgaagaagaccaaggctgctaatcaaaaagtgactagggatggaatgacttgaaatataatatagttttcctttcacataggcatggcttatcaatgttttcttcacacactccttcacaaacatggctagaggtaaagccttgaaataaagcagtcaaaattcatttttgtataaaatatttactgtattagacgtagcattctaatcatacacagcaatgtgtaaggagagcacccctccctccagttcagaggaactgaaccagaactacaacaatttacacagggctaacctgcctaaccacctgaacagaaaagcctctgtcaacatattttgtttttaaacctacattatattccaaacaagcaatgcatgccaagctacactgcatttggtaatttgtacaaaaggatattgccaaattccaatacaaaatgactatgaacacacccgtttattttggtgcttctttaaattccatttatcagtggattcatttatagtttaggactgctgaacgaacctttcaagaccatgtttctttttggaggataaactcaatctgtcttaaatatagcaaagttcaacaattcagacattgctgtttctcaagttctttgatacacaggtgagagtggtaagttagtgtttattttaggatcatttatggtaagtgggagtgggaagagatttttaagcaagaaattacataaacaaaattaaagaggtgttaaacaaattctttctttccctttagaaatttaatttacatactgacaatgtaaacaccatccacagcagtactttgatctgctaattacaaaacatttttatcttttcattaaatcaggagttctaagaggccactttaatgacttaaagggcaacgtaaataagtcttccctaattcacaccagaaattcacttggaattttttttcccttaaactaaaggatctatgcaattctttaactcttgggatggttgactcctgtatagttgattaaaatattcaacctgtttaggcccctggcagccaatcagagactggactttgaggattccatccacagttgatgaagcaccttaaactacctctcatataagatgcaggaacactatgcaattctatcaggtacaaggaaaacatttaaaattcaacatttctacagagctaatccttcaatttggtaagaggaataccattacctctggctatttctctaagtgatcaacaacaacaacagaaatgcatttaaggctctatatcactatttaaggagagcaaccctctctcaggtttaaaagagcctaaccttttctctcctatttttgaaaccacagaacaaagttctatatctgatgctcaatccagccgcaatgaaaaatatttttaattttttatattaaattattctccttacaaaactaaggtgaatccaaaatactcttttaaaaaaccaataagctgtactttttaaagcagttttaggtttcagaaaaattaagcagaaagtacagagagttcttacatattccctctccccactctacctggctctcattttcccctattattaacatcttgcattggggtggtacatttgctacaactgataaaccaacattgacacactattaactaaagtccatcccttacattagggttttctctctctgttgtacggaagttctatgggttttgacaaatgtataacgtcatgtaaccactcataacagtatcaaaaaaagtagtttcactgccctaaaaatcccaccatgttctacctattcgtcccttccttcctccccaccaaacccccagcaaccactgaactttttattgttttcatagttttacctttttcagaatgttataaaattgaagtcatataatatgtaggcttttcagattggcttctttcaattggcaatatgcacttgtatcagtcctgtttcaccctgctgataaagacatacccatttcatgctgctgggaagaaaaagaggtttaattggacttacagttccatatggctgcggaggcctcagaatcatgataggaggtgaaacacacttcttacatggcagcagcaagagaaaaatgaggaagaagcaaaagcagaaacccctgataaacccatcagatcttgtgagacatactatcgtgagaataacacaggaaagaccggcctccatgattcaattacttccccctgggtccctcctacaacacatggaaattctgggaaatacaattcaaattgagatttgggtgggggcacagtcaaactatatcattccacccctggcccctcaaaatctcatgttctcacattttaaaaccaaccatgccttcccaatactcccccaaagtcttaactcatttcagcactaacccaaaagtccacagtccaaagtctcatgtgagaaaaggcaagtcccttctacctataagcctgtaaaatcaaaagcaagctagtcacttcctagatacaatgggagtacagacattgggtaaatacaaccattccaaatgggagaaactggccaaacaaaggagttacagggcccatgcattcaaattttaaagctccaaaatgatctcctttgactccaggtctcacatagagatcgtgctgataccaagaggtgggttcgtggtcttggacaactctgcccctgtggctttgcagggtacagcctccctctctgctgctttcatgggctagtgttaagtgtctgtggcttttccaggagcactgtgcaagcagtcggtggatctaccattctggggtctggaggacagtagccttcttctcacagttccactatgcagtgccccagtagggactctgtgtgggggctccgaccccacatttctcttccacactgcccttagcagaggttctccatgagggtcccacccctgcagcaaatttttccctgggcatctggcatttccatacatcttctgcaatctaggcagaggttcccaaacctcaatccttgacttctgttgcacccacaggctcaacatcacatggaagctgccaagtcttggggcttccaccctctgaagccagacaccaagatgtacgttgttccctttcagccatggctggagcagctgggacacaggacaccaagtccctatgctgcacacagcatggggaccctgggcccagcccacaaaaccactttttcttcctgggactctgggcatgtgatggaaggcgctgccatgaaggtctctaacatggcctgaagacattttccccatggtcttggggattaacattaggctccttgctacttatgcaaatttctgtagagggcttgaatttctccccagaaaatggggttttcttttctatcacattatcaggctgcaaatttttgaaacttctatgctctgcttcccttttaaaactaaatgcttttaacagcacccaactcatctcttgaatactttgctgcttagaaattttttctgccagatatcctaaatcatctctctcaagttcaaggttccacaaatctctaaggcagggcaaaacgccaccagtctctctgctaaaacgtaacaagagtcacctttgctcctgttcccaacaagttcctcatctccatctgagaccacctcagcctagactttattgttcatatcgctatcagcattttcgtcaaagccattcaacaagtctctaggaagttccaaacttacccacattttcctatcttcttctgagctctccaaactgttccaacctctgcctgttccaaaatcacttccacatttctgggtatcttttcagcaaagccccactctactggtaccaatttactgtattagtccattttcacactgttgataaagacatacccatttcacgctgctgggaagaaaaaagaggtttaattggacttacagttccacgtggctgggaggcctcagtatcatggcaggaggtgaaaggcacttcatacatggcagcagcaagagataaatgaggaagaagcaaaagtggaaacctctgataaacccatcagatctcacgagacttattcactatcacaagaatagcacaagaaagaccaggccccaagattcaattatctccccctaggtccctcccaaaacacgtgggaactctgggagatacaattcaagttgagatttgggtgggggcacagccaaactgcatcagcatttaaggttcttccatgtcttttcgtagtttgatagctcatttcttttcattgctaaacagtattccattgtgtggatgcaccagctcctccatttacctattgaaggacatcttgattgcttcaaattttgggcagttataaataaagctgttataaacattcatgggcaggtttctgtgtggacataagttttcaactcatttgagtaaatactttggagcatgatttctgaatcacatgatgcattaatctgttcaggttgccttaacaaaataccataaacttggtggcttagtaatttgtttctcacagttttggaggctggaaagtccaaaataaaggggccaactgattctgtttccggtgaggactctctttctgacttgtagatggccaacttctcaccgtgtcctcaaacaaccggggggcaggcaggcctcttttcagtctcttatttttcaactgacaaaaactgtacatatttatggtacacaacatcctgtcccttcttataaagacactaattccatcagatcagggtcccaccctttaacctccacaaaggctctatctacaaatacagtcgtagaagggtagggtttcaacgtatgaatttggtaggggcacaaaaacagtcagtccacaacgtacagtaatagtgtgtttagttttgtaaagaaccgtgaaaccatcttcaaaagtggctgtgtcactgtgcactcccaccagcagtgaatgtgagtccctgtggatccacatccttcccagcacttgattctaaatcttcaccattctaatggtatgtagtggtatcattgtttttgttaatttgcaattctctaatgacgtgatattgagcatcttttcatcacttatttgccatctgtacattttctttggcaaggtgtcgcaaaatactcttttcactgttctatttcccagtgtggtctcatggtcatcttggagcatgatcaccaggactgcttattagaaatgcagaagattgggctccaaccagtaacaatatattaagacctttctaatacagtcaagaataccaaacactaaacagactgctataattgagggagaaacagtgaataagaatcaccaatggtcagcctgactcttactggatggattggttagagacctgcaaccattatcttttcctcacgggctgctgacttttcaaccagaaagcctcttaaagagaataaatataggccaggaacaatcactcacatctgtaatcctagcacttcgggaagccaagatgggagtatcacttgcactcaggagtttgcgaccagccgggcaacatagcgaggcttcatctctacaaaaaaaatgttttaaattagccaggtgtggtggtgtgtgcctgtagtcccagctactctggtagctgatgtgggagaactgtttgagcccagatggtcaaggctgcagtgaaccatgatcgtggcactgtattccagcctgggtgacagagcaagaccccatctcagagaaaaaaaaaagtaatatggatgggtatggatgggtactgacataatcaggaaatcaaagtcattctgtgactggaaagaaaaaaaaaaaaggagattgaaaattgacgtttgcccaaatcccaaaagtgatatcactgacttcgtacataacccctagaaaatcactggggggcttaggggtggcagtggactggttctccttaaaaataagttcaactaacctgctgaaaaagagaggcagaagttaggtatgcagctgggaaactgagataggcaaaataccatggaggcaaattattcaaactatggcaggtcacaagtcaaactccaatttaaagcccctaataaacatcaaggagttttttttttttacctctttccaagggaggagaggaatgaagggaaaaaaagtagagaaataatgagactcactggttagggaagtggggaaatggtttcccattcctctaaggagccagcagaggggagcaagttgggaggagaaaaaagagcaaaaataagagtaagaaagaactattcctagtataataccattttcaatctatctgctacatcctttattttgttttttttaaaaatgaaatgaaacctcaatctgtttttaaaacaaaagcatgattctttcctaagtagaagatgtgatgaattaattttcctcaaactttctaggtaggagtcaggagaagccagccaattatttgataaaaccaagtacaaaataaaagacttgattctgcagcttaaaataatgttaatataccaatttcccttagatttttttaaacaaaagtttgatattttaatttttgcatatttccaacagatagcagatagctaggccaaaaaaaaaaaaaaaacaacttcccaataggttcatatctgcaaagggaactttcaaagaaaccaataagacacaaagcagataaaaatgacatatcatataatctttttctttattcactcctattatcactattctatgaattaggtaggagaagcccatctgtctctcctcattttacagataagaaagcagacactcttggaagtgacggaaactttttcactgcatggccttcagtgcataagagagccaaaactcaaaccaaggactcccacctccaagacaagagaggggccccctactctttccacttcacaataatgcctaaattctaagataaaagaaaaaaaaatactcattttaaccattaaaagaaaaaaatctataatgtggctttcaaatacagagaaatcctttattgaaaaactttttggctgcataaatgtcttcttttgagaagtgtctgttcatgtcctttgcccacttgttgatggggttgtttgtttttttcttgtaaatttgtttgagttcattgtagattctggatattagccctttgtcagatgagtaggttgagaaaattttctcccattttgtaggttgcctgttcactctgatggtagtttcttttgctgtgcagaagctctttagtttacttagatcccatttgtcaattttggcttttgttgacattgcttttggtgttttagacatgaagtccttgcccatgcctatgtcctgaatggtaatgcctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaagtttgtcaaagatgagatagttgtagatatgcggcgttatttctgagggctctgttctgttccattgatctatatctctgttttggtaccagtaccatgctgttttggtgactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaacgttcttcgatttgtttgtaaccccttttatttccttgagcagcggtttgtagttctccttgaagaggtccttcacatcccttgtaagttggattcctaggtattttattctctttgaagcaattgtgaatgggagttcactcatgatttgcctctctgtttgtctgttgttggtgtacaggaatgcctgtgatttttgcacattgattttgtatcctgagactttgctgaagttgcttatcagcttaaggagattttgggctgagacaatggggttttctagatatacaatcatgtcatctgcaaacagggacaatttgacttcctcttttcctaacaaacacatgaaaaaatgctcaccatcactggccatcagagaaatgcaaatcaaaaccacaatgagataccatctcacaccagttagaatggcaatcattaaaaagtcaggaaacaacaggtgctgaagagcatgtggagaaataggaacacttttacactgttggtgggactgtaaactagttcaaccattgtggaagacagtgtggcgattcctcagggatctagaactagaaataccatttgacccagccatcccattactgggtatatacccaaaggactataaatcatgctgctataaagacgcatgcacacgtatgtttattgcggcactattcacaatagcaaagacttggaaccaacccaaatgtccaacaatgatagactggattaagaaaatgtggcacatatacaccatggaatactatgcagccataaaaaggatgagttcatgtcctttgtagggacatggaggaaattggaaaccatcattctcagtaaactatcgcaagaacaaaaaaccaaacgccacatattctcactcataggtgggaattgaacaatgagatcacatggacacaggaaggggaacatcacactctggggactgttgtggggtggggggaggggggagggatagcattgggagatatacctaatgctagatgacgagttagtgggtgcagcacaccagcatggcacatgtatacgtatgtaactaacctgcacaatgtgcacatgtaccctaaaacttaaagtataataataaaaaaaaaaagaaaatttttttataaaaaaagaatttgagaattgaggtattcaaaaactttgtatttcttgaaagtttcttctatgatggcaatagtatcccagcccatggttttaatcggtgatttttttttttttttgaggtggagtctcgctctgtcacccaggctggagcacagtggtgcaatctcggctcactgcaacctctgcctcctgagttccagtgattcttctgcctcagcctcccaagtagctgggattacaggtgcccgccactgtgcccagctaatttttgtatttttagtagagatggggtttcaccatcttggccaggctggcctcgaactcctgacctcgtgatccacctgcctcggcctcccaaagtgctgggattacagcccgacctaactggtgatttgtaagcagccctctgtggagctgagttacccgccaggagaagccattctgtggataatgaacagcccatttacaaagtcatctaggtcagctgttagaagttggaaaatctttttctacctttcctttcaccaaccactctaacttagtaggcttccagagctgtaattacacacatttcaatgggcgtcaactctctccaagattcttaacatcctagaagtcagggtagatgaaaatggcagttgtgcctccctagaaagcatgagttcatgagtcccctttacatcagtgctacccagacagagtccctatacttactgctgatatgggttgcatgtgtcccctatgtcatcttgaattgtaatccctatgaatctccacatgcggaggcagggccccagtcggaggtgattagaccatgggggcagtttcccccacgctgttctcatgatagtgagttctcacgggaatttatgattttaaagtgtggcgcttcacttgttcattctctcgtgttcattgtctgtctgtctctctctctgtcactctctcacctgcctgccaccatgtaagacatgcctgcttccccttctgccatgattgtaagtttcctgaggcctctccagccatgtggagctctgagtcaattaaacctcttttctttataaattacccagtctcaggcagttcttcatagcagtgtgaaaatgaactaatacaattgccgtcttcttttttttccttagtggcattgtcttgctctgttatccaggcttgagtgcagtggcctgatcatcatgcactgcagcctcgaattcctgggctcaagcaatcctctgacctcagcctcctgagtagttgggatggatgatggacatgcatcaccatacttagctaatttttttttttttattatttgactgtagagatggggtcttcctacattgcctagtctggtcttgaactactggcctcaggcaatccttccacgtcaacctcccaaagtgctgggattaaagttgtgacccactgtacctagccttgacagtttttaaaaagaacacaagggacatttagtcacattaacccacaatcccaaatcaattttagtatatacctagtggcattctgaatttattggacctattttttgaatctagttttattgttctctccaatttatttagtatgtttttttctagtttactgggggcctgacacttaggaagaagagtaagttcctgccactactgtacagcagaggtgctgcaatttgggcactgggggtgcatttaaaaattcacattcccagatttcactctgaaaaggttcccagtcaataggtctcagatagtgtggaggaagcatttttaacaaaatatgactcgactgtagggggcattctcagaggtgtattcagcaaatgcagccacagaacgactcagcctggcccacaaaatgaacttataaacagatatgttaaaaaccatctgtgaattctagaagcctataaaaaaggaactgattatgagtagtgaacaccaaaggaattccagactgaggggaacaacttaggcagagttatagaatatcgcgaaatgtttagggaacaaagaatcacctgaaaattaccaaacttacatgcaaactgtgaactcaccatttagggagcatcttgaatatgaaatatttcacagaaagaatactttaagagaaaggtgtttaagcagataagtgaatgtgtatcaaaaaaaagtttttgtgacaaccatgtgaaagatggtttctaaggaacatgaaactaaaaacagaaaattaattcccaaatggaaaagaaaggaagagtgtttttaagaaatgttaaacagaatgaagccaggtacggtggcacacttgtagctagtcactcaggaggctgaggtgggaagatcgcttgagcccaggagttcaagtccagcctaggcaacacatttttttaataataaaaataaattaagaatagaatgaataagaattagtgagccgccaacctatattatcatattttcattcccaagtgattaagagatcagaaaaagataaggcaagcctatgagtaaacattctacctattccaatcacatatcccaaaaaattaaaatggaagatgaaaaattagacttttagcctcacaatccatccttacttaaccctatcatctcccctaccccaacttacatgtggttttagatataaaccagaataacctgcttacctatgcttactccttcactagagctgctataacaaagtgggtttaaacaacccaaatggggtggcttaagcaacaggaatttatttacagctctggaggctctaagtccaagatgaagatatcagcagggctgatttcttctgaggcttctccttggcttacagatggctatcctttctctgtgccttcacatggtcttttcttggtgtgtctgtcctaatcttctcttcttataaggacacaagtcatattagattaggtcctaccccaatgacctcattttaccttaattacttctttaaggattctacctccaaatagtcattcttagaacttcaacatacgaatttgtggtgcatgggtagggggcacataatttggcacataacattataactggctataatttttataacttaaagtaatcattacttcaaaaactttgaaaaagtcctaaataaatactcacaagcaaagagaaaaacacactcaggtctaaccagatccctcctagaatgcaggtgcacttcagccatacgattaccaggaggtctattccaacattccaagatcaagaatcagttccaaaactatcctgggaattttaagccacttcctatgagcaacaaaatttcagacaagttcctttctcatccatccccactgataaaactaaagaagcaatgaaagagaaggcaagggcaggtggagtttatatagtgacattccaacacttgctaccaaagctgttaagtattattatggcatttttgatgaccatgcccagaacttaataaaagctcaaatttttctgtactgtagctaaatttactatagcagaaatttcttctgagatagcatgactcttcagaagccacaagcatatttaaaataaaaaaacaagggcttcaatattgtaaatttaaatggccataaacgtctgactcaaatccgtttcttcccttggaaccacctcctctctcctcagatctcaacatttaaaaattaatgggtgtgttcactttctgacaggcccagaaaccccaagttatcctgggacctcgagaggagaggaatgtacacaaacttatagatatttgagggcagaaacccgttgttgggcttagcatcaagaaagtcttatctgagattccttatgaaaccatcaaagccagttttaaaagcctatgtgaaaaataatttttcttgctgcactttatacaaataatcacgccaagtataataaagcagatcagttttaccatgatttgtctttagtaaaaataggacactggagagagaaaaattatgtttcaacaactatggtacatctgttattagattctagtctcattcgttgtttctcagtttttttcctgcaatttaaactaactctgcttattcctgtgaaccaaccagtgatctctggctgtgactcagaagaaacaatagggatgggtaatgtaaaactctgaggcagtattttaattctgggcacgtactggaatcagccagcaacttcagactatcagcttggttccaacaattgcataattcatagaaagccttcttattattttacttaggataactttgcttatttagctttactcttgtagaatacattgttgttgtactccatgtgtaggaatgcaggataagcttactcaatgttctcatttttttttttttttctgagagggagtcttgctctgttgcccaggctggagtgcagtggtgtgatctcggctcactgcaacatccgtctcctgggttcaggcgattctcctgcctcagcctcccaattagctgggattacagacacccaccaccacacctggctaattttttgtattttagtagagacagagtttcaccatattggtcaagctggtctcgaactcctgacctcaaatgatccgcctacctcggcctcccaaagtgctgggattacaggtataagacaccgtgcccaaccaatgttctcttaaattaaacatttattaatcttctagatatcacctttcgttggaactcaagagttatgagtgctcctcgacatactaatgctttctgactgagctcctctctaccctgaatacaagagaccctaataggcaggaatattatcacctctattcagcctgaagaagttacagaagatggatcttcatccctcttcaacccttaggattaagggttctcttataaaagggaggggggcaatatgtcagaggtgtttgaaccagagcaagtccatgttgaataggggctgggtaaaataaggctgagaattactgggctacattcccagaagattaaggcagtcttagtcacaggataagacaaaaggttggcacaagacataggtcataaagaccctgcttacaaaacagactgaggtaaagaagtcagccaaaacccgccaaaacccaccaaaaccaagaaggcgatgaaagtgacctttggtcatcctcactgctcactatatgctaattataacgcattagcatggtaaaagacactcccaccaatgccaagatagtttacaaatgccacagcaatgtcaggaagttcccctgtatggtccaaaaaggagaggaaccctcagttccaggaattgcccagccccttcccataaaactcatgaataatccaccccttgtttagcatataatcaagaaataaccataaaaatgtccaaacagcagctcatactgctgctctgcctatggagtagccattcttttgtttctttacttctctaataaacttactttcacttaaaaaaaaaattactgggcatgggggttgcagggtgccgtggctcacaactgtcatcccagcactttgagaggccaattcgggaggactatttgagccaaggagttcaagaccagcctaggcaacaaagtgagatctccatctctacaaaaagaagaagaaaagaaaaaattagccaggcatggaggtgtgtgcctgtggatccagctacacaagaggctgagacaggaggatcgcttgatcccaggagactgaggcagcagtgaatcgtcttcatacataccactgcactccagcctgagtgacagagcaagaccctatctcaaaaaacaataaaataaaataaaaattactggaaaaataaggttatattactttataatttatattataattttatattaccacatacttcactaagttatccataaaatcagacacaggaaacatttgtcacaatataaaattttgtcaaaaccataaacaggaaaaatagaatagatcctgtatctatcatttgaaacataagcgttatcaaagaaggaaaatcaccaatttgcaaccccaataaaatagttaattcaagctcatcaaaaaaagatcagcagtagatgctaagaccattagagaaaagattattgtagcacatgacgtttgaaagatacaaagtgtcataatgctagtagcagtaaccacaaaaaaagaaagacacgattttatataaaaagtcttatcagattcttttcctctactttttatccctcacaaaagcacatatactatctgaatcccactgtaaaaagaagtccgggaaatctgttaccatttctctacctagctctgtccaatacggcagccactagctacccatgactgttaagtcctcaaatgtggcaagtgactgaggaattaaatgttttattttaaataatttaaattttaaaagccacatatgtctagtggctattgttttagacagtactgctgcagggtataaacaaacctagccatgaaagacaatataaaaagtcacaagcttaaattatgggcaggcttaagggaaaacttgaaaaacttataaaactattttataagcttttatcaccagataattctgtatcaggaattgcctccattgaactttcttatagcatgttttcttgactacaaaaaataaatgctgaataaaagcttgcggaattaaatttataaagctttaaacctaccccaaaacactgaattaccaggaaaactatggcatttaattaaatgtataggagtaccctgatttaagacgtccctattttcatgactgatttttaaaaactgatttgcagttttcatttaaaataataagctctggccaggcatggtggcacacgcctataatcccagcactttgggaggccaaggcaggcggatcacctgaggtcaggagttcaagaccagcctggccaacatggtgagaccttgtctctactaaaaatacaaaaaattagctgggcatggtggtgcatgcctgtagtcccagttacttgagaggctgaggcatgagaatcgcttgagcccaggagctggaggttgcaatgagctgagatgtgccactgcactccagcctgggctgggccacaaagcaagactccatctcaaaaaataaataaataaaataaaataataagctgcttgaaaacattaaaaatgtagtctcactcacaaaatattattatgggtcccttgcaattacacattaattttaaatcagcttgtcaatttacaaagaagccagttggagttctgactgatagggactgtatgtaacctgaagcaatttgggggagtattgccatcgtaatattaagtctcccaatccatgaacatggaatattttttcatttatttaaatagtcctctatttctttcaacaatgttttgtagtttcacagcacaaatttcacatctgttttgttaaatgtgttcctaagtattttactctttttgatgctattataaataaaattgtttccttaatttcattttcagattgttcattgcaagtacgtagaaatactatctttttatactaatcttgtatgctataaccttgataaattcatccattatggggatagtacaggtagtacctcaattcatagggatcattagactaataaggtaattattggagagtacccagtactcagcctggcacacagtaggccactgaagtacttttatttatctagggccttacaaaggtgtcttactataaagttgttatttaataccacttatgtgcaaaggtctgagtaacacagtgacttaaaaaaaaaaaaaatcctgtccataaggagctagaggtcttactgcagaaatagatcatccttgtcccacaagtaatttgtatagacatcatattaaaaatctgaataagatttcctttacaacaaatttaccttcatatactgttaagagcctcagaagaccatctacttttcaaccatacaaatgaggttcatccctccttcttcttactatgtttattactagattcttccataactcttctgaacaccagtattactgcagagtggtgtcatgtattgcacttgaccaataagataagaaagttttagcgtcttgtaattactagctttgttttttctttctgtgaagcctatttcatgcttttgaattttcagaagagaaacaaaaagaaatggaaaataaaaggagtaagagattacaataagtaaggttcctatagaactgcagtcaccaattctgccattctatagaagcttactaatattttttaactaaaacaatttttttccaaatagttctttaaacttagatatctgcttagtgttccaaagcaccatttaaaatcaaccaggtcctgtttctgtctcagcaacatttgctttacttctaaataattgttaatttacatttatttgttggaagaaagacagccacaacctaacaaaccacaatttgtgccacaaagtctaatcttagcccagatctatttttggattcataacagcttgagctaaagaagaatttcattacattgttcaagttgggtcataaacagtctctgaaaagagaagcaaaccaacataaaatgctgtagaaaccaaaaatgatataaaatatgaaagattcaggttcaaacatctgctatataaatggaaacattactgtgctcatcttcaatctctacttaccactttatgttcccaaaaaactccgttcctaccaaactataacttatttaaattacactgaaatttatccacttacaaatctatctccccttcgccccacatatgagtctctgagggcagagaagccatatgtctaactagatgtgtaaatttggaagagaagtaggatgtgcaacataaggcatttccatcccaccccaataaccatccaacctgtaagttctcaaaaatggctttagttttgcttttatcattctaacagttgccattagtcattctttaggtgaggacactacagccttcagtgaagcactgctcagacagtatataagacaaatgacacaaaacaaaataaagttatctaattaccagaagtgatgatcagtaaactgaatccatctaagttttagctaatttacctgatagacagtacacttctaaaactacctttatgaagtgctgagctatttaagtgaaaccaaataaaggtgattcactcaaaagctgtccagaaaacctggtggcaatgctaatcaatttaagcaaatcacaacataagtttccaattttcttttccaaattagagttactttcctcaaaccctattctgctgctttaggcttctgattaggttaagaaagggaaacaaaaattaaagggaaaagcacaatattcaatgattaagagatgtgccaaatttccacgtatccagaggactcaaatcattagaattttctttgagtaggccaggcgcggtggctcacgcctgtaatcccagtactttgggaggccaaggcgggcagatcacgaggtcaagagatcgagaccatgctagccaacatggtgaaaccctgtctctactaaaaatacaaaaattagctgggcatggtggcacgcgcctgcagtcccagctactcaggaagctgagacaggagaatcacttgaaccagggagatggaggttgcagtgagccaagatcgtgccactgcacgtcagcctgggcgacagagtaagactctgtctccaaaaaaaaaaaaaaaagagaattttctttgagtatcatgcaatgatgactaatatttataaatacaatcctaagacataaagttcctcaaatgccttcagaatttctgaaggaaaactaaatcacattctgaaacaattagtaaccagatgtttaaaaaaaaaaaaaaaaggtagcatgaaacctctcatgtttctccccattgtccatggtaaacataaccaagaactgaatattgtactaagccagacttaggcctcagaatccttctcattagaccaacctaaaagtagagatatgacctagaagcatggtataaacagagtaaaacagtgatgagcttaggacttggagtcaaaaggcctgagtttaaatcttagttatgccactctaaaaaagggtgactatataatctatcatccaaagagcaatagttctgacaccaacacaggacaataggtatatacttggactgtcctcagcaaaacaggacatagagtcaccatattcataggccacatggaccatgggcaagttagttaatcttcagtcttggatgccacgtctgtaaaataacaaggtgtaaaattaaaccttcagtaactataaattgcttagctttcttcttttttcacctatataatattatattgtacgatgctaacccagtgagttcagaaattgcaagaacactgcacttatacagccttataaagagaaccctcaaagagatgaaaatccatctttgacagattcaggataatttttttaaatccacactgattctctttcttatcaaacatttcacttgcaatgttgtccaaaaaaaaaaaacaaaaaacaaaaaaaaaacacttagttcaaattctgatacctgggcagtactaaacactcagaactctgtttccacagcttcatttttcatagcttcataaaagcactcatcttgttgtgctgttattgtgtttgtgtgtatggaaaacatgcctgatgccagactaagcatttccagaaggtaagaaccacgtctgttttgttgctatcctccatgtttactgcagtgcctggcacatagatggtgctcaatgttggctgaataagtaatcaatactttagaaatacaaccccttccttaaccaaccccaactggtgtacattctcaacccatgaaaatattctgtaaggatgtatccttcttttcccatctgagtgttcacactcctcaggaataacagcaatccaaatgtttcttctctatagagtgatgtcacctatttcccgattaaggaacccaccttgaaatccaactagattttaggcttttgggagattcccattttaaatccttactcagaagcttctgatccttcacacaccatcttaaaccttactcttctttcaaagccagaactgactgcctgaacacccaattatctccacccatttccacttcttttatcctaccccagtgaactattttcatccagccataactatagagccttcccctagaaagtaaggtatacatgacatagatcactctacttattatgggagaatcagaatccaatgggaaaaaatttaaaccaaagcaaattaatacagtcaaaattcaacggcaccttcaatggtaaaatggctttaaattgtgacaaagccccaggggtccctaaggcatttctagggtttctttaaataaaaaaaaagtgtagtcaatcacagacatgtttgctttttctctgcaccgttgcccccagactcagattgctctaggggctggggtttggaggcaaaacaatgaagcatttgacaacgtcaaaacgtcagaatgacattctggaaacaaacttcactttgggctacccacttaagtagagacataccatgatacactgcccacctttagttcagaatattctccaggtgagaggaacaaataattaaggcgttttgtattcaaaaagatgtctctggcttccagatcaaaaatagtcatagaaagtagaaagtttattctgcgtgtttctaaaaaaacacatgaaaacttacctagcaaagtctcacacttcactataataaatgatctgcaactgactgtggaaaatatgtaacttttatatggaaaaatacttagctgtagcaacagcagactgttcttaccccaagctaaataacaacagcaatatgaaactgtaaatgtctactaagatagagttggaaactttgtgactccactatccctcctcccccagagtttcttttgctccacaaaaataattttagtcagatgggaatagggaaaaaactgcaaacagaaagaagtgtagtttcaatgtgagtacaatattgagtgtcctgaaagcagacagatcctcaataatgtagcttcaataaaaacttcctaaaccctttctttttttgttcctttgagaaaatgaagcaatttgcatttacagcttagttcctgtttccaaaatatccctttaactttttcttttctctttttatggtgggtataaatagcaccaaattgtcaaatcacagctattttgtgtgctacctatacaaataggtctgatttctggccagtcataaaacaattactgctgaattcctctggctctttgatatccagcttgtccaccgggcttcaaagctagactccaggacttttcttggggcactgctgaaaaacaacctcaacagaaacacagaagataaaatgttcccactcctataaacacacaaagatataatcccagaagtaaaacaattcagcagcactgtggtgggttcttccccctcacgataatttaagagtacaagtattttaaattattttttagcgatatgaatcaatgagaacttcttcccgctaactcgtatggctattttctccattttcaagcctccaaaaattaagaattactttgctttcagagaaattttctgatttactaaaataacttatcccatgggaacttactgggatggaatgaaagttcagcttcttaagcacataaataactatacagcatagtatttattcaatgtagcaaaactcattcaagctagaagctttcaataaggttaaatgtggtcagaatttcaataaaggaattgtatgtatgggcaaattatatgttttgactataaattaacagaactttactctcacatggcttataaaaaaatctacatttgtatatgggatatgtgggatgggcacatagacacacaaacacctaacccatatagtacacgcatgtgctcaggagtgacagtcaaactatttcctgttatcccactgcaaaagcaatacatttattacaaggaagtaaatgttaagtcctcatagagacacttagaatttggcatcttggaggagtggcaaatgtaacatgattatcaaatctcctactgccaggctcttgtaacaatgttttattaagtttgatacacacacacacacacacacacacacacacacacacagcatatgcacacatatatttatttatctccacctaaaaagagaaagacatgtcactttttaattcctcctgccaatggcatcatgccaaatcaatttttccttaacccagtatttttggcagctttatcataatatgccataattccacaaattcagtagttggctaacatgtggctctgaattaaaagtagatatgatatagtctccctctatatatgaaagatcatttttagatatatacataaaataaagactacctttgcacctaaaatctgcctctaatttctccttctcactttctctttaccattagcaagaatcaagcacttttgaaacattaatccagatctgattttggcagtcttctataatcttatccaagaaaccacttggacatatttatccaaagacatatagccacattgtttttcaaaatctatataataagccaactcttataagtatataggttagccttctatttataaccagaaaacttagagccacctgtttcagctctgatctcaagaacaccacttttacctcttaggtcaaatctggcacccgcaacttagtactaaatttcctcaaaataatgtgattatgtaatctctcaaatttcattatgttttttcctctgaattttgttaactaaggccaaatgcattaacatacaacaaaattctcaatgtgagtgataaaaatgcattaaaagtaacccttaatctatgctattaactgattttattctattttggcacgtttgaagtaactcatctaaggattagttaggcttttctacacttctttttatcaggactctaccattcttgatttagttttgagagaaaagggtttgcaaaaactataataatctcacagctggagatggctggaaagtccgttagtactcattgtgcccttaatttgcaggaagcctttgtgctcttctactcctcgttttacatgctgagcagttttcactgataaagtacttatagaccagttattttagattaatgaaaagcccactaaaattttatgtacagtggctgtgaactttctctttaaaatactgaaatttatcttgagagtcttgattacatgaaaatcttaaccctggtaatttgcctcaatagttttcatgtgaataggcaaaggcagtcttaaaattgtttaagaagtattattttcaaacacagaaggtatccaaaatttcaggctatgaattcagattgaatggctgaagcctcagggcaaacacactgatttaatcacgtagcagtgggtttcaaaatcttgccctcttaagacttaacaataaagtatttccctgccctttaaatctatagcaataacgcaaacacattatacagaaggacccaacattgttgaaattttgttgggatttttaacattatgacatcaattccaggagtacatggtattattctaactctacacttatccaagatgagattttaaagtcaatgagttagtatttcctctgaacttcaagcctaaaaatgacatttaaatatccaattatcaaggattataagtcaaactcaattttcacagttttctaaaagtcttcagatacaaaaaacaaagtctaactttaaacagtctaagctgaagtttttaaatctgtcccaatataagcaaaaatgttgagatttgttatattccaagacatgaaaatataatcatgttaaaattactcattttctgctatactaccttcctgtaaatcagaaattcaaatcatagtcatatagattcatataaaacacagctagcatatctgcaaagtagaaatgatagtgtttgaaactaatagggttaaacaatttattttgtgaggccactggcaaaacctacagcagctgtctaactttgcctttaacgatcatagcaaaagctcaaggaagtgatccaatgcagcactggtctttagtaaccagatcgtttctatttcattttcagccaacggaatggataacgaaaacaaaattatgcctcagtcagtacgtttacttgacaagctaatttttaacaatgttaaacttttattcacatatatggccagaagtaagttgtatcttttttctgtgtagataatcttaataacttttaaatactggctacacaagataaaacttcagatggctatcacttctttaaactcacttataaaaactactggaaaactttttagctattcaagaacatattaagctaaaaaataaaaggcaaatggttagtcattgctgtaaactgttgagccatagatgtttgattctttcagtgaagaaaactgcaggatttataccattttatagaagacctaaaacaactgtataatgatttttataaaagaaacaaactcaattcctcaaggattacaatttcctaccaaaaactacttacactgttcaaaataaaccaaaaatagctctctcattacatatcatcatctggttactatcaatgtatctgagatacctattcctacattcttttctacttaccctgtggaaaacaggtatttcagacatctagctaattgggacttataaatatttatttatttataaatcaagtgtctgaagaatgtgaataacggaaacaaagtaatttaaataagtgacccaacaaagttatgcttattagtctagttaataaccacgggttcatactagaaagaagctccaaaataatttcaaactaagttatgtgggaatagatatgacacaacattccccatttcaatatttatgatgcatatgtaactatattgtcttactcaagtaattcgcctaaagaacaattttaatccagtatttaacataattccaatcatgtttacttccacaaaggtttgggccagaacaattttagtcagattttaagctagtataacatttatactatatgccataggtaagagatactaattgattataaatatatcaaacatactttctgattatgagtcctatatcatcattttataccatcttaagtagaagaaatctcacttcaactattaagcatttgaagacaattactaagtgttggttttgtaaaggagtacaaattacttaacatttaataattaaagtatgtgcacgaatggatattcctaaactgacacacttatgaatggcttactggttttaaaaagtaactcccaaatgctgggttaatatgtttcactttagggacttaaaccatacttcttcaaataaaattaaataaattagtttgcaagtaattaatgacgagaattcaataacgtaaaactatccctgcgtattctctatggctgggaaatttagctggttatgttcatataatacacttagtgggtcttggagcccactgcctgtaaaatctcccatggagattcaagaccacccattgaaaatagaacattattgcctccagcaagaagctggtacataggactggttattcaagtcttttaaatactattttattgagggattgcaggaggtgggggaggggtgaaggcggattcatgagtggatgggggaggaaaactcagaaaaaaacagtaatttctaaagcagaggttcctgccgtacccccttcacccacccgtacttttaaaacagctacataaacaaagtaataagtgctcaatttcagagagaattacattatactccatttgaacaggctacaaagtacttttatttgaaaagctgcttgtgctctgttataaacaattttactctgcaccaatttcagacaagagaagatggctagggagtgtgggaggtggagttaggaaaaattcactcagtgtctttcaatgccttaaacagttgatccaataaagatcctttagagaaaactttaagtctattttttttctccaagtaagcaaatcatacaggagggcttttcttttctagggtactgcaccctgtctctttaaattccaggcctgccccatttcccacgcattcaatgaaagccccacgtttgctggcctccagcccacaatgtcaagtagttctcttgctattgaatttcaagattattcttttggatcatttgccctttagttttaagcacaccaaagcaaaaataatgtctttctacaataacataaagaaaactcagaggtctttacaagtctacaagtagagaacaccttgtcctctggttcctctttcactgcaaaatatgctcccactccatatgctccaaataagggccatttgtacactatcgtcatctaccatagttttgtctgtcctataacaaaattttatgagtatttttatttaatttggtgccaatttggaatctctttgcaatactcaaaccaggtcttcatattgctcaaactctccactcttcaacttggtgtctggggtatttggttataacaagttttaaaacaattacttaattttaaaactattattttatttttgcagttaagacatctatataaattaacttactaataaaagcagcaaataaacattgccatctgtactcattgtgccaaagagtatattttcctcattcttgtatacaccttaatcctgaagaagggattccaggccattatcaatcacatttagaattctctcaaaaggaatagacatagttaagcagaaatttgtcagcagaactaaattaagttcatggaatataatcttattccaaatgctggcaaatagaatttgaagttgcaattttattcaagcagctaataagaaatacccagatcataaacatcattgtttatatttcacaaacattctaaggtagagttaatctatttgtattttatggattttgtaaaatcatctactactaaagggaaaatgcccttatttttatttgacatatagctttgctatgcattagtgcacagtacacttttaaagtttaatgtcaaaatgcaaatgtgttttctcacggactataaaatcatggacttaattagataaattttagattgcagagagacccttgagacaactaaaattaacctcctcattttgcggaaatcatttttagttatgcttaaggaatattcatatcaatctgcattgtatataaaacataaaattatgtactaatttccctttgtaaaaacctctagttatttttgtagcttatatatgaaatattaataaaatcatcttagtatcaaaatagtttgaatttatggaattatgcatgaattctccatccaaaaaggaccacttctttctctgccctaaatctttttttctctatgccttatgtttggtacttgttttggtactttttatttcttaaaagttcatgtttaacttccaaattatatacaaagatgcacacattggaattgagtcttttatttccaattatcaatactatttattcttcaacataatcaccatatatctaagcaacatgatgacagtctttttatttgtagttgatttttaaagtcagatgtaggctctagaaaaatttttaacactacacagcaagatagacatgttaattatcaaagttatcaaaactccacaggaaaaaagggccagaacttttcaaaacattcctaagtactccaaaaatgtatactgtactgatatattacacatgggtatctttctgttaccaagactatcctatatgaatacacatttataaatcaggttaatctcattacttttataacttcaatacaaaatgttaagaaaggtaagaacgttatctacatgtctccctttaaagcttacgatcaacttatgaaacattgtgcaaatactcatagtaacattaaaggaaaagactcaaaacgacaaggtggcaaaaatgtcaaatagcaaaatttgaaaatgtttcttgggaaagacagtcttaatcatgttccaaattacttgtagaaaaaactaaaaatcttattgtaaatgtgcccatacatacatttaaatactagttttactttcacataatatgagtcattcaagaaaacttgaaaaagccaacgaattttactgacaacaataagaagttcctgatatcccacgtcccagagatcacttatattaacattctacgatagtatttcttcccatcttttcagtgatgtatttttatctatcacatacttctcaaaatgtggggtaaagatgaacaaatctagccattctaacacagaaaatgaactgaatcaatgatgttaacctaaaaaagatactctgtcaagaagcattaactataagctattgtttagcctttacaatgtaagaaaattcctatttatttgcagctctattttaaatgtctgcatttgtgtatttttggataaattatcggctctagtcaattgcttgacaatttcctttacagaattggaatgctaactaaaattattttttctttgacctaaaagttatacagcatgttacaactgaagagtagaaaagtacttgcttttcaaaacaacttcaattcagcatttgaattattaaatagaaaaccctatttattcttatatgtatgtatgcaagtatgttggatgatcaaaaatttcatatactttcttctaatctgttcacatgataatacagacagccctcaattagcttacatgggcagtcctcaattattactctattgataataaaaacacaagtaatatctggtaagtgatacttcagaaaagcaaattaagtgacacaatttcaaggtctattttatgtaaaagacaaaaaagcatgaaaaacccaacgatctaatggcatggtcaagagccataattgaggaagaagtttcctatcaacactgggtggtcttctgagttcttgaaatgctccaatctacaagtaatagttgatggttgaggtgaatggcaccgatatgatcagaaattaacttttacaagtgtaacttaatcccttatttggtgaattactcatgttatcttctacttccctattactgcagcaagtctttcacccatttcactgtccattcaccataagaaaggataaaattccaatacactgatgttcatatattggtattttattttctcaagaatatcattctccgaactactacttaggaagagtcagaaattaaatactccacatgtctattgtctagcatgataaccaatatagctatttaataaagggtagttattatttcattgttataaaaacactagatcaatgacaattgcagaatttatcctttttaaaactaaaggaaaaacagtattttcagagctgcaaaagcccacacagcttattcagtccaaacacatcctttctacctcccaggccagggcctttcctgccacactgctaaatactgctcctaccagttactggaattacattagactcttatttttaaagctaaaaggctggttgtatttcatggattaggtagtaaaaaaatgatagagctggccaagtccttcaagtttgtgtctagcttttctttttaagcatccaaagtaagtgaagaaagaataagggaaaaaagagaaaagagaaaaattcatttttgcctattacaaatgctagaacacattctagaaaatgtgattctcagcagacacaatgtttcctgctaaattcaagtggtggttctgtttacacaaagtcaattattagaggtgcagaagaaatgagtttcagaaatctgagtaataatttataacttacaggagtggaaagtaaagccagggattctaaaaccctttttctgacttgcaatacctgcctttatacggttgccaaaaaattccagggtcaagacattacattgatggagctataagtagtatctacagtgataacataggtcccatcctttctgatgtgtaactctaatgcaacacaggaggaaaaagagataacatatacaaagagaagggagtgttggtctaatgaaagcatgtaacacataacacgtgctgctttggtgctccataaaatgagggaagttagcttccagcccactagttactatttctgtgcatacagagaaaaagtcatacaacaagcatcagacaatcttgaactgggtcaacattttcaaataacgtgttccactcaatgcaactaaatctcaacagcccaaatcccccatgtttcattgactctataaaacagctgcttattatagagaaacagagaaataagtaaaatgaaggaaaatactatgtgaaatagaagaatgtttcttcaatataaaaaaggtcgtaattatttagctttcattattcatattaatgaagtatttgtggtaaagggtaaagatgatataaagtctacaatgaacctggtttttaaacacccaaagtgttttacatgtttatcaaatgaatagatacctggaataatcagacagtattctatccccagtaccatccttggagggaggcaggggaaatgggacataaaaacctatctgcaaaaatgaaaaggcatcattcagacaaaatttatatctgaaaacattaagaggcaaattacctccctactctccaagccactgctattattattaatacttcaggaaactgttaatatatattttgcttttaaaaatcaatatacacacacagagcattttgcctggtattgatgaggaaataactaataatttctactggaaaggaacaaagaaaaaaaatctagttttgacaaaatcaaatattttaaaatagaaaaaaattaacttggctttgagaatatcaaccttctaatatgtgtaactaattaaaggtaactaattatatttataatcactaatgaacactattttaaagataagccataattttctttaataaaaaaaatggtgacttgattttatccaaaaagttaattgttaactgctacataccaactaaatcacacccaaatgctggccttatctttttagaaattctatcgtaatagccttcttcagtcgtcaaccactgcaaacttaccacacttaagtcaaaaggattaagtcatgcaacattacttcttaaaacaacaccctgcatccttcatgtaattgcaattcttaccactgggtgaattggggacaaaatatcaggagataactaccacccagcaacaattttttctaatgatttaatctcaaaggaaaactttaattcatatagagaatttgattttgtctgaaagtagctatagaactttttccttttaaacagcatctaccatggttaccaccacttaattaaatcctagatcatgtctacaaaagcagctattgctgaacatttgtctgctaatataagtgaattattactcaatgttttaaaagtaaacattgaccaccatttattactagttatctttgcacaggcatacttgtgactcattgtgtctacatgcaagattgctccacatttctaggcttctgattaaaagtaaaatgaaagggtaatcgaagatgaagaatctcaagtgtcctttccagctctaaaaagacacagcacactgaaggcagggacctcctcttactcttatttgtatctccctcagtctttcactgtatcctacatatatattgccttttggttaagcacattactatggccacgaactaaattcttaaataagaccctaagcccagagaggaaaacaaaacaaaataaagcacatcagtttgacaaaattaaaagcttgcatatggcaaaaagataccataaatcaagataaaagaaaaaaatgaggcaagatattttcaacaaaaataacaaaggaagaacatcctacaaacaagaaaatgacaagcaacccaatcttttcttttaagaaaaaggatataaaaagaagtcaataaagaggaaatcaaaatagtcaatatatatatataaaatgcttaatcccaccaggaaccagagaaatgtaaatgaaaacaaaaagataccaaatttcaactctgaaaaataggaaatattaaaatagccaaaattggcaaagatatagaggaaaaatggtactcattttcttgacagagtataaactgtcagaaccactttttagagcaatctgacagcagctagtacaaatgaagacacacgtgcccacaactcaataactcaaaatctaggcctatgtccaaacccttgttcatctgcacaaggtaacatgcacaaagatgctcactgcacagaacagaaaatgacctatttatttcttaataggaaaacagaaaagtaaagtatacaatatattcccatgatgaaatactaagcagaagaaattaaagagaatgacgtggctctttatagatgaaatgtggacaggttcagaaacagaattgagtgggggaaaaaagcaagatgcaaatgtattcactcataaaaatattctggtattaaataatggcaatggttacacaaccttatgaatatactaaaaaccacagacttgcacactttaaaagggtaaattttgcatgtgaattatatctcaattgtaaaaaaaagattcactagcatgatcctcttcacgttgattttaagacacaatacattattatttgtaagcaacatatatgtgcaaaataaatagaatggaagacagactgaagggttggaagaaaaggctgggaagcattttaaaacattagctgcatctataatagttaattctccagaatccaaacaaggaatcaaataagataatatgtaaacatttattcattcttggtagtggggatttgaatgtttgttatatcattctctgcatttccccatgcttttttttttttaattaaaaaagcagccatggactacaaaggacaaaaaaggcacatcacaaaagacaaacggtaaataaatacataatgaaagatatgtggcactgctaatcatataaatgcaaaccaaaatgaggcagtttttccacacagattggcaaagatttttttaagctgttaatttccagtttatatgcctgaggaaatataaactgggacaatctttttggaggaaagtttggtaatatataacaaaattttaactctgtataccttttgactccacaacctcccttctagaaatttaacataaacaaattattagaaaaaccattaaaatgaatgtcaaagatgtccaccacagcactattcataacaaatcaaaactgggaacaatccaaaagaagtataataaatccatatacaatgtcataccagaaaaatccaacaattttaaaagatgatatgccacaagggtaggaatgttcctctgtgctttatctccagctctaagaagggtgctagggccgggcgcggtgcctcatgcctgtaatctcagcactttggaaggccaaggcgggaggatcacctgaggtcaggagtttgagaccagcctggccaacatggtgaaaccctgtctctactaaaaatacaaaattagccgggcgtggtggcgcatgcctataatcccagctactcgggaggctgaggcaggagaattagttgaacccgggaggcagaagttgcagtgagccaagatcatgccactgcactccagcctgggtgacaagagggaaaccctgtcccaaaatgaaagaaggaaggaaggaaaggagggagggagggagggagggaggtaggcaggcacgcacatagtaggagctaaaaaaaagcacacacttgttgaatgaatgaatgttaatagttaatattgatgtgtatgtgtatatatataaagatgtctaacaaatattaactatagttatatatgaaaatttcagataactcgtccatggtttgacttttctacaatgaacaaatatctacaaattagaaaaaaaaaacatttcatttgtttaaaaaaatgaacaaggttcttcataaaagctacaccacaaaattgtgccatgtaatttcccagcttctatgacatctcttttgaagattcaaaacaagaaaagttctatatcttagaactgtaaaagtgatgttatgtagtggggattacctgtaataaatgactagaaaggcaagaaaggggccaaggttggtccatggaagacccatgagaaagaaacttcaaagaaccaagagaaggaacaaaggacctttaaggcaaaattatcaaaccaagtgatatccctgcctggcctacttcataaagataggtagttctacagaggggcacctacaataatgaatataaaagacttctgcataattcaggtaatgcatcacagaatggacagtgataggccgggcacaatggctcatgcctgtaatctcagcaatttgggagatcgaggctggtgggtcacctgggcccaggagttggagaccagtctgggcaacatagtgaaaccccatctctaccaaaaacacacacacacacaaactgccaggcatggtggtccacgcctatagtctgagctgtttgggaaatggcttgagaccaggagatgggaggatggcttgagtccaggagatggaggttgcaatgagctgaaatcacgcaattacaacccagcctgggtgacagggccagaccatgtgaaaaaaaaaaaaaaaaaaaaaaaaaaaaaaaaaaaagaatggatagtaatagtagctataaaatatgcccagaaaaacccaagtttaaattatccttttctgaaaacaattttgttaggtaatcattcaccggaatttaatgaggcaaataccttggaagatttaccttttctctttccattaaataagtttttattagcaacaataataacaatcagcttccatgtattgggcaatttatgtgtgccagattgtaggctgaatactttctaccagcagttctcggagtgtagagttaggatctcaggatccctatgatcttttcaggtgattggtgacgttaaatctatatatataataaaatctattaagttatgtgcctttttccttcccattctctcgtgagtgtgtagcagagttttccagaggctacaggacatgtgataacacaatagactgaaaagagaagctggtaagaggacctagttgtcttctattaaaacaaagagatttgaaaaaaaaaaaaaaaaagaaaagaaaagtaaacaatgcccctcttgtcactgtttttaagaaaatgttcatttttcattaaaatgttacctgtatgttaacatataataggttactacctttagacaaattaatttctttaaaatgtctccattttaatttctaatacactaaaattaatagatataacttacacaaaaaaactctatgcgttcttcaatttgtaagtgtaaaaggatcttaagcccaataagtatgaaaacagttgatttacatttcaacctcaacttatgaggtaatagttctattttatcatcatttccataatgcaaatgagaaaagagacacagaagtaacttgtccaaaaccatacaaggagtctcttaaaccaacatttgaatacaagtctgtaattcctaaccctaaattctctccatctttaagcaacaatatctacccaagatattaaagatcacttttagatctttaacttttagatagctacatgctaatccctatttttaaaacaatattctatattggttttttattctttttcagttttaaaaagttatgtgtgctcattgaatgttttaaatatacggagttaactttaaaaaaaaatcaaacactacaaaaataacctcccatcaccaccacaagtagctactaaactactagtaagagtttgatgcccgctaatgcaaatttacttatttacagacatacacttgtatagacatacgtatacttatctgcacaagcacttttttgaaaaaatgagatcacaatgatttagcaacttgccttatttcacttaattattcttgaagatcttcctgcatctacaaatagatatacctctttttatagattatcatcatttaattgtatccagttgagggcccctatatggctttcttccaaattttgactattacaaaaacagtcacaagaaacatgctgtatctttgtgtacttgtgagaacatatttgtcagaaaattcctagaagtaaatttgctaggctaaacagtataaacattaaaaatcttaatagaccttgccaatgttctccaaaatacccctgcccgatttacattctcacccacagaatatgagatttccaccaacaattcagcttttaagtgccttggaaaattatactttatgtgcttcaaaatgcacagcagtaaaactgttctcactggtcatctaaatttcatacagaaccctacacaaataacactcgctgaatctatcagaacagtcactcatcttcattttgttccttatatcttttaaatgactctgaagagaaaatataccagatgcacacaacgtcttcagctagtaagccctcaagtattagttaccttgataaaaacttacccaaattatttcagaagaccatttaacacaaatcaaaactatgcagtaaagctggcctcatacacttaaaggaaaattgttagagtggatttattaagctttatctgcccactcaaaggactaaggctacaaataaaaagctatcaaatcctaccagtggccaaattagcttccataaaataataagcaacagatttcatatcataaatgtcagtgaaacaaattgcaatagtaaggatggctgtaactggaaaaaaagttcactcaaattcacatcatactaaaaacaaaaacattaatattttaaaagaaatgttttgaatgtgactattcatttcagtcatatcagactagtacaaatctttggtactaataaataagatattgtctttttttgcaggtaaatagtttaaaaatgcatcatactctgacctacctgttttgtcatggctaatagacattccaggcttcaccatttcatcaaaatctcttttctaagattttgtgccattagttttaaattgaaggtctcccacccatctttgtgacagagtaaaacctcattaattcaaatccaattagctcaattctgaaatggtatacataattctcattaagcaacaagttaaaaatactataattttttctcctacaaattctaatattactgtgaagtaaaggaaatcaacctgaaaatcaattcacttttccaaaccaaagatttacaaaactaaggactctttcatctttgtggctgagcagttcatcctcagtcctaaggctcatctctgtttagcagctactgtatacagtgaaagtgatttagattgtcactatagccaacacagcttatttattatagaatatgagcatttcttttaaagatcttataactcagatttctcacaaattcatattttcagtttctccaatttccaattggtagaattttactctatcacttatagatctacaatatagctaacataacactttaaaaggtactggaagtagacatacaaattcttggcattcttattctatatttattcttatcattttgaaagactttataagccaaaaaataagtcccaggattaagtggcatgtttggtgttgcttgaacttacaactattcccaatgaacagagaaaccttctcttgcaatctgaatcatgtgtaattacagtatgacaaggtctctcctgggtgatgtaagctggcacttttcccaggacttgtcacatcatgggaagcacgcatacaaataaaaatccaaaaataaacattttaaaacaatggcttatagactgcatagagaacctccacagttgagtataaaaattgaggaatccaaccaacaagcagacatctctcaccagagacctctgagaagtcatcactgctatcaagcagcttaccacgcctagcaacaactcccaggtgtggcctatgtgagcagcaccctcatgttccctcagggcagacagaaaatcattaagtataggaaataaaaataacatcaatgcacacatccactgaagcagaaaaacaatggtaaaatagaggttgatcatctttaatttcataatgccaatttgttgattgtcaaggtgcctaaacaaagttaccttaagagctacatcttctgccaactgagttaattttcctaataaatgttgctttttaaaagcttatttcaccttgaagtgaactgcagccaagtagtagtaataatgtgtaccaaggatcttagaaagtggtttcttttgtttaaactcctctgctctacagacacatggaaagggagagagagaatccgagaagcagcatatcaacctcatcagcgatagaaatttgacatcgctcatccttaccacagtttggaggaaatatgaaatataataatctctgactatattttaacataaaatgctaacaaatttcaaatgttatttcctataggccatgcatatttctagccctctataagaaactggatttatttattaaccatccaacaaagaccatcaaattcaaccgttcaagttttcaggaggagttataaaccaaaccactaaaggcaaaaaatacaatcctacttcccattacatgagctctggaaacaaaactaagcaccaatacaaacctctgccacctctaaggcacacgacgcttctcctttctttattcagccccctgaatgttcaataatttccacacagctctaagcagaatggatttattatgatattactctaagaaacgacaggagttctagatgccaataaagattacggatcaaatggaagataactactaaccattgtgtcgacttagataaataaacctgctcacaaacaaagcaccttattgtatttgtactgttaccttcactaatccaactaaaacaaccagacattagttttccagaggttgaagggaaaagaaatcggtatttctcaaaccctctttaaatttctttcaaaatgacactccgtttcttttttccaaaactgtcctgcccattatggaaaatgtttgggaccacagaggcccagtaggattatgcaaactagactccaaggctaagaaccaaggtggggagggactaaagcaaaaggcttcctccacatcgttcctcttcaacttagcttcgacctttgcaagaacagtctccctgcagatcacatccggcagacactttggaacgttgctcagaatcaaaggagcagtcaagtggcacgcgggggtgggagggaggaacgagtaagccccccaagtaaacataaaatccagactggagtgggtgtggcggtggctaagccacaaaaagaaaagtctatggcaactggcacctggtgcctcatacacagacaggaaagcacagaagaccctaaagagaaccgacttgccaagaccgaacaataactacatccaatacattctttgctaataacacaggtaaatcttaatttctctaggaaaacacacacacacacacacacacacacacacacacacacacacgcgcaaagtgtttattccctccagcccgattccccacatctccaaactcaacaactaattgcaccttccccacagaacccgcggctaaccccagaggactggtgagggctggcttgggatgaataaacactcgacacctgacggtcctttctctgcggtgactttcaccaagccgaagtggcgcgcgcgcgggcaggcgggagccgggacctggcccgcgcggcgccgcgcacccggatcccgaggctacgccggcgagcgcggcgcggggggcggggagcgggacagcgggaccgcccgggccaagcgattgtttcaaagacattttttatcaagacccttttgtattcgagccctacctctttttggcctaggaaagctttcgtgcaagtggaagacgactttctccacaaagtgctgtatgttactgtgctccggaccgcgtacgaacaccatccagtcgtgggtgaagccctccacggtgggttttttcctcacctgggcgcggtgccccagctccagcttcacctgcacggcacactgcgggcagggggaggagagacagccgtgaataacaggaaggcgaggtttcggcagtgaacgttgcgcctgacatttttttcctccttcttgaaacgcacataaaaggaaacggcggtgccctctgcatccacgtttcacgcgcgtgggcgcgcacactccacacccccaaatatacccgcccgcccggcccggcttggccccaggcgccccgggccccgcatctacatcggacaggattgtaacggaatgttatccccagtcgggaagggggtcggggaaaagagggagaacacactcagccacgacaagcacgacaacaaatgcatcggaaacaaatcagaaggcgatgccggggcggtttcccggcgtgggaggggaggtggctgggacccagggggaccgaagggctcctggcgagccccctccccgaaagtaccgcggcgacaggcacacgccgaggaagtctttgtgtacgtgtgtgtgcgtgcgtgtggagcgctgtgccaggcgaaatggaaactacaggcagcctctgctgatgggcacaaactcccgtgctcttgccacggggttcgtgcacaacaaaaatgagacgtcgtcatacacactgaaacacacacacacgcccgcaggaaaacacgccgaggcatccataacttagagcaccccgcaccccccagcgaaaagccccacgcgatcggcgaggccagtcgaaccgagcccccgcaacacactttcaagagcccaagtggctccaaagtatctcccacctccccccaaaaaatgaaattcagaaaggcagggcggcgggcggacagccgccgagcctcggctcgcgctcagcacctcccggcgctggggcaaagttgcgtgcggccccgccgctgtcagccccgcacacttcggctcacacacgcgcgccgcggagaacgcaccatcgtagcggccgcggcgctttgcggaggtgcggccgccgaggctgctcgccgcgtccccggactgtgcccgcagctcccggcggcggcggctgaaatatggctgagttattattcgcctccttccaccgtgtgtgtgtgtgtgtgtgagtgcgcgcgtgtgagcgagagggagtgtgtgagtgcgcttcttgtgactgcaaagaggcgaggagggagggaggcgcggggggtggaggggcgagtgtgagcgtgtgtgagtgtgtgtgtgtctgtgtgtctgtgtgcgcgccgggggggggtgggggaggaggggagcggaggctgagggagaggcggcagctccctgcaagccgtaccaacctttctctaattggaaccgcggagcgctggcgctgtctgggctgcggcggcgcagggcgaggaaggaaagtgggggagggcttttattattatttttgcgcgtacttaccgagctagccatgcctgggggcccggaggtttgctggggtgttgtgtggtacccccccctcctccgccccccctcagctgtaattcatgaagaggctgctatgaatgagagcgcgcccaggagcggagggtagatggcggacattctctgcctttttccccccgcgctcgcttgctcgctcgctcgcttattaaactcagccccaaaagcaaaagcagcagcagcagcagcagctccagggtaaagaagatgattgcggagcatgcgccgtggcgcctgacacccgggctccgagcctcacagggcggagggagggcttgcgggcggggcggagcgcgcggggaggcagagcgagcgagccagggggagctcgaaagagccaatcacctgccacctcccgaaaccccggcggcccgcagcgccacactggaaagcctcgcttaaagtaacaggttcctgctgggggggtggcagggaggggacgcaggagtggggagagcggccagctggggagccatcccagcccctgtgtaaactctgctcgccctacaataaaaaacggattaaaactgctggaatgtagccactgcttagagccctcagcagccggagagggggtgttaaatcaagtccttagctagtacgcacggggaggagggagtgggctttcttttactttccaccacgtatttctgtggttttgtgctgaaaagacaagaactcacacccaaacaaacttacttaaagagagcgagagaaatgccatcctgcaaaaaacgagcatgaaaatagcaatgactgaggctgttctaacccgcaacgatcccctggccccctgccccatccactcacaggcacccgcccgccaccctcactccccgcccttctgccaccgccaccgaaaatttgaaaatgaaatgaacaagggagaaacaaggatgctatttccttgcaagggaacgccttccgctttggtaatccccggctgggaagcttcataaagcggtgcccaggtgaaagcaagacacctgggagtgccgggtacagaccctcggggaccaggcttggagttgttttcttcggggggcttcccctcctgacagcctactgagttgcatcagaacgtggaggattgtcctctgaggacgcgcggggcaaccgggagtcttaaaatagcagataaagttaatactgactgtaatgtgcgtaaattggattataatctttaggcgtattggtgacaaccagcgtaatccatctctgagtattaatccggttagactcccgggtgacagccagtcgcaggagtgttcccagagtcgcgcctctgcaaatgttctcactcgcgttgtatttgatctcagtggccggagatagaacagcgcggccacgcgtggggcgcggagaggagtatcaactactggcttcctttacagacgcagataacctttaaaaaggaaacggataagatctagacgattgatttgaaagtgaaagatggatgtgactttggttcgttaaaaaaagatccttgcatcttcctagcccttagacctcttttgccttctctttactcccctttttccctcgccttccaacttcttgctgaaccttgatttttccttctcttctccttgcctttcctctttgtccctctttctttcctctttgtccctttctttcctctttgtccctttctttcctctttgtccctcttcctctttctgactgaacttccttgctttcctcttttccctttacttcccttttccacaaaagcaagttgtctcggcccttgaattgagaagagcagaatagcggggaggacgttacctagggcgtcctgtgtcctcgctgttaattttcagttctcccagcagctctcacaaagatcctgggaatcaggtcggaccacttggaaccaaccttagtttccaaaccagcagccttccaactcaacttttgattccctaaaactgatattccgctgcctgtcagttataatcaagaaacttctttggcttgaggtccccagttcttcccagccttctacaggatttagcatagaatggagcaaacgactgaaggtagaaacattttaatctaaatccaagggcttagatttgtcaactgacacacatatacataactgcatatcatcctgtaggtatatgcgtcgctgtgtctgtatgtatgtacaaggactacgtttatattcgcagagacaagctgtgtgggtagtatctacgtgaaggggggacctatttattgtgcattattaaacttttcataaaataatcaaatttgagagcagtcctttgtaataatagtattggaaactaaaggttatctggacgtgccattagtaaagccatttcttattaagaagtaaccattaacagcgagtgtagctcaggacacaggcaaaaaacaacaatcccattccccgtttgagttcatttcagggtttaacttcttccggcgccagccaccggactctcttgagattgtctccaaaacttgtacccgcacaacagatagaggtctcttttttgaattatgtgtttgctgaattcagatttattccagcaatcactaataagccatagagtctgaaagggtattttcccagtacccctccttcctcaaagaatgctctaacaacccaacgtagttactcccaatctccaaatactggacatttagattccgtcagtagatggcgcacggagctcttccacggacgtccttacgtgaccccttcacaacaaaaagatcaggaagggggagaaaagaaagaaaagaaaacacaagactgaatactctcccttcaactttggacaaagaaatttatgcaagtctgtcaatttattaattacaacctattttaataagcttgccattaaaaacaattaaaatcgattaatttcctgtgcagatcttcacactttaacgtgaggtaaaaatgtggaaaataaccttttgtgtacttgacaatgtggttatagaaaatgtactgtaaagaaattttaagacaaacttcagtgctaaatacagaaatagtaatataataactaaaatggaagtggtgagggataaaatcatctacttatccaaagaataattatcttaccaaaattcatactgttgtatatagcacagtatgaagcaccatggggttagtttgaagatcagaaaagtaattaacatatcaaataaaaatcgtgatgaagaataaaagagaacagtgtctgtgacagatcactaccaccactaccatcaccattgccctaccaccatcattttggctccagcctttttatttgcaattgttttctttagtctggaagctaaagccagtttccatgtttctggcagaacaaagagagggcctttaacgtgtaattagagtgttaaggagcatcctaaaataaacttatctatttgttgtgatagataattgatgcacaaattcaaatcaataaaaatttaccatttatttcccgtcattgctgtatagacttggggagaaaagaggaagaagaagcatggaaaaaactagaaaatgtgccagactctaaatagacattttgcaaaaatcagactcaaagtaattaaggattcttcttccataattgtgcacctttttctgtgtactgcatccatgtgtttattcacaaaatcattccacgtctcaggcagagagttaggccctaagactgtaagaatgacaggattcctgatatcagagtttataaaccaggggagaagtttcgccaaaaacttttttttttttaaatttcataacagctaaatttgggataagatgcgtgtcatatataagcgaggagcatagaaacctgacatgaacagcccaaggacaggaaaaacagtggcatgagattagaagccaggagtcattgtccttaattccaccttttaatacttaaaaggtggggagaggcagatatctttcttgcaacagcagccagttcctactttcctttttcttgatctgaagtattttgtatgttcacttttttacagctcttttagggagaaaaaaaaaaatcccacaatgaaagaaagctaagtcttttcaagatcatgagcaattctcagttgaaatcatctccccatttcttatggaaatttttggttcaaaatgttacatgtttaacattatatttaattcatgattctaggatagtgtgggaacactagaatggtaagactcattactattttgaaaaaaagattgctttgatagccgtttgagcacctagtccaggactatttccagagataagaaatacacagagcttttttaaccaccagtgcctcttcatgtgtaaattattccctgagagtaatttaagcaatgcacttatacatgcagaagacaagagtgcctccactgtaataatttattaatttagtgggctgtatccttaatttaataagtagcacctcaaggcctgaaaattaatcaaggatgtcgtgtaaaaccagcaatatgaaacaaaataagtattgggggacagttgatatagagtgattgaaagagtctccctaatatatacaggatgcttagtggaatagttctaggtaaaatacatattgagttgaaaatgcttgctgtaaaacaatctatctaaaaagtagaccaaatgactatatctttatgtatctctggcatctcttcaaacgctactgtgcaatgttccttctttctttatgtaatgatttgatctcttttatttttaatggaaattctgtttgtttttatatatgagttcacctctcccactcacatataatgaatcagggcttaaaataatcactttatcttaaaataataaaatatattttgtctttttggtaaaaatggaaaaataacatatcaggcctatgaactaatttggacagctcaaacttcaacaaaaactgccaaaaacttaggaaaaagaagtaactcctagccgggcacagtggctcacgcctgtaatcccagcactttgggaggccgaggtgggcagatcatgaggtcaagagatcgagaccatcctggccaacatggtgaaaccttgtctctactaaaaatacaaaaattagctggatatgatggcacacgcctatagccctagctactcgggaggctaaggcagaagaatcacttgaacccgggaggcagagattgcagtgagccaagatcgcaccactgcactccagcttggtgacagagcgagactctgtctcaaaaaaaaaaaagaaatgactcctttccatctactaaatggtgtgacagtggcttgaaaataatactaagcctctaagaagccagtgatttactaccttctggtaggatcaagtatcctggttgggttaagctatttactgtcagccttgaataatccatgagtatattacctactttgcagataatccacaatgacacaatttatgtttgtggggttttttaaatgtaaatgtatgttataggcagggtttttaaaactatacaaaatgtatatcactgcatctacttgttactttccattcatagtttttctcacagaaaagtttatatattatttcattctttctgttttggagctctttctaaattttactaagaaaaactttctaaattttattaaccaatttttcatcccagatatagggtgctttggcaaaaaattcttgatctaggaagcaataccaatcaatgggaaagaaggaatgttcatttacaatttgctaaatcaaaataactcttaaaggctattcctaattataggtctattacatatgctctatgaatccaaataagggaaagttagtgaagaactgtcttctgcactgtattgataacagtttgggagaaatttcatatagtaacaaggagatgaaaataacttaaaaatagctaaataactttatttctgtatgatcaaacccttaatatttcttatttcaatcttttcttatgtttcatgactttagcattttagtttgatgattagtttaatgtgttcagttaacttttattggctttctattgaaggtcagctacttttcttggtcctttcaaatcagggtaagtttaggatgcctctaactctcatttatttcaaggcatttcataattattgaattaaagttgacaggttgccacaataaatgaaagatgttattaagcacataacgataagccctggttattcacttgtatccttatttaagaaaaaaaaaaagatttagccatgacattgtagtaacctctactttaaaaaaaaggctgaaattatttactaagattaaaacaagtattgaaagcacttccaaattaaaattttactttgaagggatccaactagtcaaatttgggacaatttgaacttcagaaagaatctatcattccataatggtactttaaaaaactaacaagaaggttgaaaacaaaacttcttcttatggaaaaatgctagctaatatacataaaaggaacgataggatcagaaaagtcataattttgcagactccataacagtaatagatttagtcaaggctcattagtatatgctgaaagtattaagtgaaagattttggagaatacattattcacaaaatctggtgttacagattacatattaattttatatatcaattttaatttaatgttatagtatcacagattacatattaattacaaagggagaaagagacctttacagtggaaacatctcatggacaccacttaaccaagtgattaaacttaccgtcatttctagtgggaagagctgacatcatgtacctcttgaagtgatgcggtaaaaaagcatacagcatcaccacctatgtatttttcttgccaaaaatgtttaacctgaatctaatcaagaggaagtaatcagacaaatccagattatgtagaacattttacaagataactgacctgaactcttcaaatatcagtatcataagggccaaaacaaaaaaaccaaaaacacaaaaaaacaaaaagacgaggataggtccagattaaagttgactaaaacatgacaactaaatacaatgtttaatacttactggaattctggatccaaaaacatgtattataaacacaaaatagcctaaaggatattcttggaataattggagaaatctgaatctatactgtatattagaagatattatcaaagttaaatttcttgtgctaataggattgtgattagacaggcgaccctcctagtttttggaaaatacatgccaaagtagttagggtcgtgtcatgtctacaacttaccctcaagtaggtgagtcaaaataataaagatacagattaagataaaagagagataaggcaaatgaattgaaatgatcattgtactgccttttcagtaaatttgtcttttttttttttttaagatagggttttattctatttcccagctggagtacagtggcacattcatagctcactgcagcactccaactcctgcacttatgtcatcctcctcccacctcagcctccagagtggctgggattacaggcaccagacaccatgcccagctattttttttttaaatttttttatagagaggaggtcttgttatgttgccagggctaatctcgaactcctggcctcaagcaagcctcctgtctcagcctcccaaagtgctgggagtacaggcatgagccatcatgcctagtctctttttttcaaaacataaattgtagggggaaaattggctcttaagattcagaactaatttaggaagtcactgttctgtatatgtatatgtatatgttctgtatatgttatttgatgattttttttcttaaaaatatatgcttaataagaacaaaagtaggacaaatgagaagagaaaatattacaatctaaatgattttatttttaagtaaaagattgaggttatagtttttttcttttttcttcttttcttttttgtcagtttaaagctttacctattttatgttttctcctttctgcctaccaccaaatttgtttttgaattttaatcatgtgacggcttttagttgactgacatgtttgaggtcagcctatttggtgatctcagcttttctctgggaatgaaggactccaaagggagcaagaaactagacataggtttggcatgccctgctgaattagtgacaatattttcatggaatgttctttcaaaagtagaggctgtgtatgaaaggtttccctcatgagattacagcaatttaaaggtcattcaattctacagaccgcttaattgtgccccattaagcatttctcaaaaagaagtatgtgtgttttaatagcattcaaggactgccaatatcagcattgtctaacttagaaagattatttttttcatggcttttatcactgacccggtgtataatgcactgactttccttttttattgctcaagggcagctggatgagtagccttggctcatttagaaaccatctaatgcttttgttctcagttaatattttctttaaaggtcacctacctctgacacctgtcaggttagtacttctcaaaatcggaaataggaccttttcttgatcaagtacagccaatgcaatgtctgaagattggccagcagttttgaacaaatagcagatgaacagattgctctttgagctgtcattttatacccaggatctttatggagatttttttgccaaccaggtaccagagaggaatgtggaaagagtagactaaataacagggtagagagctctgtgtttcctttccaaacttgagagagaatgcacaaaggcaccactcactccttaaaatgtctgtgaggggtagagaaggtcattaagtgaaaatgtgaatttaaaaaatcaggtcccaaataaagaacaaataaacaaaataaatccaaaccaatttaagataaaaacttccaaactagaccataaagcaaaatttatgggaattataaatatgatgacagtgttctggaaaaattctttttactgtaagagcaaagcattcagagactggttttgatttttattcagtaatcccaatgtggaagctgtaattgtatataacagtccatgtagtttctcaattcattagttgttatactgtggttcttacccaagttgtggtactctgtaaacaaaagccaccagaagtgtcttttggagatgtcagacctcctaacctttccttcaatcaaggcctttaattctcttatacaaccctatatttaaaactatgtactggtcttgctgtatcccagacgttttgattagagagctaacgcaatggtctgacttcaagccaaaactaaagttgaaccttaaggcagtgatcatatgcacatggcaggaaaaagatataaacgcagtttccaggtcataatgcaaaatattccaagtcattttgtcttccttgactcaacaacatggtacagattttttagtgagacactcaaggctttgatttttattttattttggagagaatgggaagaagttgtaattattctaattaaaatggcaataaccatattagtggatgaaattgtttattgattctattgatataacatattcaacaaatacaaaacagaaaagaataactagtttccctaacattatagatgtatttcacaaatattactgtatacctattatgtataaagcacaaaaaactaaattctgcaacttgaaatagaattcaacagaaagttaatttggatggagccatattggttaaaggaaagagataaatgtaagaaaaggctgggtaccgtggctcatgcctctatttccaatagttttggaactattcccaactactcaggaggctgaggcaggaggatcccttgaacccaggagttcgaggacagcctgggcaacgtagtaagactccatctctagaaaaaaaaagaagtaaaaaggcacaggtaagaaagacttcaaagtatgtagagaaataagaaaatctgttaaaaggcaatgttgaaaaacttgcaagtacttagtttttgagttttgatctgtttcctagcataagtctactcattaaataatgagaaacaatatgaataaaataatataggcacagtttgaatttaataacaatttagaaatggagaagcaagggcatttgtcattacacaggattctgtcattactaatgaattttgtcaaggttaaggtacaccaatcctcatttttccagttgggataaatcagaacattcctgattctggttttaccatagcaggagtctttagcttcattcttttcccctccactccagtattttatcatattggttgttttgaaacgctgctttgtgtttcatgggttgaaattctgaaaaattagatctgaaggtaattgctgaggctttatgatttaattttacatgtttggagacgagttcattgaacttacaagcagataaatgaaaaatgctacaaaatggcattaaatcagtcttagcatttttttccttttaaaatattgacctaaatatatattggctaaacttctccttaatgtcaaagataaaatgattgaactctcgggtataagcaagcccacttggcaaaactggggagcagaagtaattctgagccaagcacatgtctcaaaaaggaagttctttgacacgagaggttgtctccaactggcagagttcaggaatagcagacttgcccaaaataacaattttgagccatcttactctattgtagaaatagaaaaaaaatcatttcaaaataatttttcattaagctaatagtagaaaatgtatttaacttaagaataaagatggcccaaagtagctgttaagtcaaaggtaaaaacaacaatatttttagaaccccaaaatcagttttcatgtttgtttgctttttctttcagtgaatacatatagttttctaagtactcattctctctcagataataaaactaaaagcctggcctttttgagtcatgaaagttctcatctactagtcacttaaaagccatttttagaaaagaatgtgttttgcaaagaataaaaccataataaatggaggacatatacaagaagggggagggagagaattagttatagactatgattgtttactaagtaaaaaagtctctacatgacacaaaattatctttgagaacatgaagtagtaattgcaaaattatgtcacgctgaaattacctaaaattattctggcaagacacataaacatgtaaaacaccagtcgcctttatctgcaaggtttaaaagaaatgtgtttatgaataaaattccatggctaagacaaaggatatgaggtggtggctggagaactgaattgaacctatatcctatagtgtttgaactgaacaaaatttttggcttatttatttgtttaaggtagtggataatatgtcaagtttggaaaatgttacataaaaattcgaattccctgcttctcctggggaaaaagtaaatcagaaatctggccacccagggcttacctatccagaagactcagctgaagcggagttcaggctacccccttagactaggtactcctcctctagttgtccacagttctgatttccccaatttactcatttactcaagcagcccagctcttgaggccctttctgtggtagtgaagataatctcatccttagggtcctgttgttgatatagaacagatgtgggtaatgtatggtgggcgaactgtggccaggaagtcgagtcagactctaagtctgttaaagaaaaacttttacatctttgaatagttgaatacaatttttaaaaggatatttcatgacaagtgaaaattattttaaaattcatatttcagagcctataaataaagttttattgaaacataacaaaggtcgttagttttcatatatctatggctgcttttgtgctacaaggatagaatagagtggttgcgacagagaccacatggcccacaaagcctaaaatgcttatccttttcaaagaaaaaaaattattcaatgatacctattaaagcacaataaggaagactttactcagcatcattgagacaggtacaggaaccactacaacagagcctggcagtggaggcggaaactgggttcaactccagatacatgggcaagtggaaattcgtagtcgaggagcagggtgtggttggatggaaatcactaagaggaaacatcaggggcaaaagtgagtctggctaaaccgacctaacaggatttttgttgaaggcaggccagggtgaccagacatcacctggaggatggtggaggatgagaagcctgatcagatattgagatggtcagattccaagggtaggggttcttgctaaaactgagtttaattaggaagtgcacaaatgggcctaggagaaggttcagcagactgactaaagtttggccaagcaaaaaatctttgtcagtatctggcctttatgggaaaagtttgctgacccaatctagaacagtgttgttcaaaggtaatataatgtgaggcacgtatataattttagatgttctagtagccatatttttaaaaagcaagatgataaaattagttttaataatgtattttgtttaacccaatataaccaaaatatcatttcaattgaaattaatttaaaaattattattgctatcttttacattccttttcattctgcctttgaaattcagtgtgtatatacttgcagttgtgaaagttatcagtatgaaaatggagtcactaatataaaaccctaacttaatggagcggggatgccgtgaaggaggggtcctcacacatgtatgcctataatgggaactatgcaaggaattcctcgaaactgcagtaacctgatttcacaaggacccttgcctaacaatggctatttccaccaataagctaacaactccagcaacacgaccctgtaatcaatggtctttgtttcaaaatgacttatatggacatttattttgcctttaaaagcttcccctttgccccaattctcttggatgcacctatgtttttcatagcacatgtatccctcattgcaatcccttgctactcctgaatgaactctttgctttgtagagttggtctctcactgattttaggttgccacagtgtatctccaataggattagccacctttcaagggctcaatagctaagatggtgctagcatgttggaaggacatcacagatttagaatttaagaatattagacggcaataatttagcaaataaattaaataaattatgatttcttacacaataaagaactcagaggtgtaggaaaaagaataggaacaaagtcccaaagacttctaggcttaagggtgaaagagggttggggtggggaaagtgaaagtgggctatgagagataaggctgcctagctgaatagactagccaatgggagaagaagagaggatttttaagaagtattggaggtctgtgagtccttttcatgaggttcaaagaaaacctaaaggtcttggtatttaaaaatatttatgttcacatagcattcatttcttgtcaaaagaactgctctggatttgaaccacaagggattcaaaaacttttttttttttaaagcttcagactattaacaaatattttaaagtaggaggcttttagtcaaaaggttgtaggctgggagatacatctgtgatccaaagctttctcatttccatagaacatggcctgaatacttcttgccttctctaggactgcccatacccctgctttgaaggagggatggctaatctgatgggtgagggtctgacattcattgagtctttcacttctggtgaaagtttccagtaattaatagccaccggcccaagatctcttttccctccacactgtcagctgcaacacaggctctgcttttgcataccctctctggtggcaacagacatataattccaatacaatacagtcattgttaaacagggctctgatcaaggtagagtaagagcagaaaggaaagaggtgcagggtttggaggaactcgttcacaattggacatcctcctttactatccacatcactttttagtcatgctattttgtagttcaacattactatggtgaagttattttgagtatgtattgttttatgtgaaaattagatggtaaaaactcacttaaacagtatatacatataaatgtgtagataaataagaattcacttttgtaaacccctaagataatggcaaaaattaaaaacattgcttggacaatgcgattatgcccagaaaaaaaccgtgtcttccataagtttttgatttaacacacacttatatatgtcagacactgttgtaagcactttacaaatattaactcttattccaacaatacctccataatgctggaatacttttacttccatttgagacctgagctagtaagtagcaatgttctggggtgaccactgtccttgttttagtactgacaagtcctgcatccttatagaactcctcagtcccagcacaaccagcatggttggtcatcctaaaattcaaaccctggcaatctaattccatactccaggctattaacatgttttctctcttataacagtgcagggataactctagtaaatatagaaacaccatgtgtagaaatggaccaaacaaaagcaaccctgaaatctgggcctgctacaagatgctctacttatagacgctacaagtagaaattcaccttcaactcacctagtctcccaataaacactctggaatgtactagggttgatttgcatcagttgcttgcagctggagagctgcaaggcaattgcagaatcttcagaaaggcagagggaggagcagggggattggaaatcctctgataaaatggcttagaagatgactcactcttcctaagtaggacccagtggcgaacttgaaaagtctgtaaatccaactgggagtactttatgttgttttctgctttgtctgactgtttctgtacatttatatattcatggctattaaataaacttccgttgtctgtgtcttttggccttttcctttcaatcacagtaacagccttgttgtgacagcaccacactaagaagactctgtcaaggcagggagcccagaggacagagaaaatggctgggttgtcccatgggcagatgtgaaaaataccctaaaacctccttcatgtggtgaaggatgcaagtaaaagataggaaatatatcagcagggcctttgagtctaagcttatgcaatcacctctcaaatcacttgcttttctcttccaccttggcattccaggaggagcatcactactctccacctgtcttcttctttggccaatagtaggtaaaaaaagagccaacaacagagtaggattcctctccccccaattcatatctcgcttctcctataaaaagacatagagagaggaagaaacaataaatactatttaaataaatgattgtgcttggtttcttccacctagattttgtgtagaactacttgctgtgagaaagtaaaaaaaaaaaaaaaaaaaaaaaaagcctaattgagatttgcatattcaaatacaagacaaggaaaatgcacccaatctgagatgggagcttagagaaagaataactgaggcattaacacttgagatgatactggagggtaagagtttatcacaaggatgaggagagggtgtcacaaggatgagaatgaaattgggagcaaacatttaacagatattcttccttcagcctggaaagacactaggaagggtgggggtgggggggcactgagaaaggagaaggtatggcaagctcagtagctatacttattctaaggtctgactgaaggaaagtgttgggagatgaggaatctcctcagaaagggtattctgttcatgctcaacagattaagagttttctatgcctgacaagaaaccactgaaaaaatttgagcagaggtatgatataatcagatcacagtatgagaatatttgtcacagtcctcaggaacgtgccatgcaaagccatggttactggcaaactagttattaaatggaccagaaaaagaaaaacaaaacattgaagagctcttcaaaagggaatatgaaaccaatgaaaacgatgaaaatatttaaatatatgaaacaacataagtcaaaaaatgttaaggctgggtgcagtggctaatgtctataatctcagcagtttgggaggctgaggtggaaagattgcttgaggccagaaattagagaccgccctgggaaacacagagaaaccccgtctctacaaggaattttttttcttttaattagctgggcatggtggtgtgcacgtgtagtcccaggtactcgggaagctgaagtgggaggattgcttgagtccaggagtttgaggttacagtgggctatgatagtgccactgcactccagcctgggtaactgaatgagaccttgtctctaaaactaaaaagcaataaataaataataaataaatcaataaataaataaaaagagaaaataaagattttaaactatgtaagctaaaaatgtacttaaggatgaagaagagatagttcacagaatgaacaaattcttgacctcaatactgatccagtaaggatcagggagcatgcattttccaaactgtctccaacaatagcaaataatggtcaatggctggatattctaaaccaatgtaaagtaatgtatagaaaagtcataaggactggcttttggtctctgattgcctcactaaatagcactttattttgttttttattttaaaaagtagaatgagatttgttttaatccttagcatatatgtttattgggctttctgcaggttattgacttttttttagagacaatctcactctatcccccaggctggaatgcagtgctgtgatcatggctcactgcagccttgaactcctgggctcaagtgatcctcccacctcagcctcccaaatagctgccactgcaggtgcatgccaccacactcagctaattttttaaaaagatttttgtagagatagggtcttactatgttgcccagcctgataggtttttatttatttatttacttatttattgtcatagggtctcactatgtcacccaggctgatgtacagtgacataatcatggctcactgcagcgtcaacctcctgggctcaagtgatcctcccaactcagcctcctgagtagctgggactacagccatgcaccaccacacctgacaaatttttgtattttttgtaaagacagggttttgccacgttgcccaggctggtcccaaactcctgagctcaagcgatctacctgtcccagcctcccaaagtgctgagattacaggtgtgagccacagctcccagctccaggctggcaggttattgacttaaaatttcaatttttacattctttcctaatgtttcatcacagtttattttctaaaactgatattctatatatggttttatttagtttaatacttgttcattgagaaatatttcttgaatgcctatttttttttccttaggccctaaggaaccaataattaataaagacagatggacaaatctggctgctgtctttatggagtttacagtctagtggaaagcaaacaattataatgttatatgtgtaaagaacatgacagaaactcagcttgcctacccaatatttattcgccacatctttcttgtgaagagaatcccagcttagttaggggtaagcaacatgcccaattgtagcagattgtatttccccaaaatggccacagtaatattttgttttttgttttttttgtttttgagatggaatctcagtcttgtcgctcaggctggggtgcagtggcacgatctcggctcactgcaacctccgcctcccaggttcaagctattctcccgcctcagcctcctgaagtagttgggattacaggcatgcgccactacatctggctaatttttgtattttttcagtagagacggggtttcaccatgttggccaggctggtctcaaattcctgacctcaaatgatccacctgcctcggcctcccaaagagctgggattataggcgtgagccactgggcccagcccacagcaatattttggtccacttgctcttccatacctcgccacccccagatcaagttgtaaaatcgacttctcttcccctttaaccaggcagacctttgtattttccacaatgaatagaatacagcacaagtgataatgtgtgacttccaggtcataaaaggcgatatggtttctacctcagtctctcttgggaccctcacccttgggactcagctatcgtggtgtgggaatccaagaacccacatgaaaagctcatgtgtaggtgttctaaccacagttccaactgtgtgagtcttcttggccggcagccagcaacaattgcctctaggctgatgccaagtgaagcagagacaagctgtctctgctaagctttgcccaaatggcctatttgtgagaaaaacacattttcattctaagccattaacttttgagttggtttgtttcacagtaatagaaacctggaagatctgcttaaaaaattgctttacccagccttcctggcagattggttaggcatgtgacataattttgaccaatgagatagaaagagaagcccatgggtgaggcttctgagaaagactcagcagatacatgactgtaagatctggaccctttgttcctccttctgcctacggcgcagtgacagctagagctccagcaccattttgtaagaatgagaacaagagccacactttaaagattccaggacagacatgtagaaaaggtgctcagcatttttaatcattagggaaatgcaagtgaaaactgcaatgagaaatcatttcacacttctaaaaggacaaacattaaaaagattgacacactagattttgatgtggatgtggaacaagtagaatttgcatacatttctagttggagtataaaataataccaatctttgataaactgtttaacagtttctaataaagataaaaatatacctattctatgatccatctggattcaacttctaggtgtttatgaaacataaagacatatcttcacaaaaagacttacgtaagaatgttcatagtagatttatttgttataggccaaaatagggaatagtccgtatgtccaccaatatgaaaattggtaaaatggataaattgtgccacatatactacattggaatactgttcagtaataaaataagaatgaactactcatatatgcaacaacataaatgaatctgaaaaacgttatgttgagcaaaagaagcaaaatacatgaatatacatatactatctgattctacttacatggcattccaacacatgcgaaaccaatgaattgtggtagaaattagaacagtaactgcattttagaggaattgaccaaaaaggcacaaaggaattatttggggtgctggaaaagttctactttggaaaccagttgggatattggttacccagaggtatacagtcatcagaattcatcagactactcactaagttatgtatactttactagatgtatattataaaacattagttcactaaaaataaatatggtcatacttttcaatggcttatttactagtgagatccactgaaaggagctatgacttaaatattattgatttgctgtgatagctaacttacagcagcaatgtttaaactaatactaggaatgaaaatattttggtgaccaggtctcacctacaagtaaaatactatctccaattcgtttacccaaaacaaatatattctatgttctacatcaaaacatgttcaacatgttttatttctccttttcccaagctaagataaccataacaaggttatttaggcaaatccccataccagcaactgacagggtttcttgataaaggtgatatctcagctgagatctgggttacagaaggatttatcagccaaaaaggaagagagagaacagaagtaaaatgaagccccagggacaagggaaaaatacacacacacacacacacacacacgcacacacacaggagagagagagagagagaaagagaggtggagagacaagcaggcagtcagaaacagagagataaagaaactgaaagatggtcagtgtccattgaaaaggcttaaacaactatctaaacaggagaaatagtgcttgattgagaaagaacacagagaatcttgagaagtatcttcatctggatggtggttaaatgggtatgcacatatgtaaaacccattaaactttacatttatattagcacacttcacatatttactgtacatatgttatacttcaatttcaaaaacagagaggactgagtcctagacgacagttaaaaggaggtatgtggagaaaagtggctagaatggagatctgtttaggtggtagatttgattaggcctggtgacagtttggatgagagagggaagaatataagtatgagacaccttcacttctgagttgggcagctggttgaataatggtgcaaataacctagataggaaggaggaaagtttagggaatgcggaatggtcagctttggacatgttagggttctgaataacatctaaatagaaaaagcatctttgttagtgtggctggtaacacaggagcgcagttaaatatttgtggaataaataaatgctcagtaaacagttgaataactaggtgtgaacatcaggagagaaatctgaagtaatgagacatatttagtaaaccttagtgttagaaagtgctgtttttctatacaatagagctttagctgggcacacgattccccaaatatagactacatttcccagcctctgtgcagctaattgtggccatatgattaggttctcatttgtgggatttattagaaatgatgttttcactttctcaattatgccttttgtaggaaagaagcatgtcgctgcttcccatggggttgaatgcaaatatgatagtgaggtcattttgaccacatggatgagggtcgtacccagtggctgtcatacattaaaaggacctcaggttctctaacctactgggccaccatattattcctggacaatatacacaaaatattacatgagaaataactctttatcttatttgagtattttttgtctcttgttacctcattctagcctttatccaagctaatccaactattattaaaaccaggggagaatgtgactaatgagaagtatcaggagagtgtggaattgtgaaggctagggaaaaggacaagaaaagagtagtccaccgtgttacaggcttttcaaggaggaaaggattcataaggcatcacctcaggatgttgaattttattgtgtttggatcattgttacctaatcacttaaccacagcaccgcacgaagcagctctatctcactaattaggctaagtccagtaaatttcttctaatttttgtttctgatctattttggctggtgtgaatgttaagactgagtgtcaacttgattggattgaaggatgcaaagtattgttcctgatgtgtctctgagggtgttgccaaaggggattaacatttgagtcagtggactgggagaggcagatccaccctcaagctggtcgggcaccacctaatcagccgccaagcagaagttgtaaacagcagacttgctgaatcttccagtcttcatctttctcccgtgctggatgcttcctgtcattgaacatcagactccaagttcttcacttttggactcttggacttacatgggtggtttgctgggggctctcatgccttcaaccacagactgaaggctgcactgtcggcttccctacttctgaggtttggggactcgcactggcttccttgctgctcagcttgcagatggcctactgtgggacttcgccttgcgattgtgtgagtcaattctcctaataaactccccttcatatatacgtatatcctagtagttctgtccctttagaaaccctggctaatccagctagtaaacatgactttgtcttggctaaaaatctcaccaacacctctcattcaagaagaatttcatcgctctaatattgtatttcaatagacactataaaaggtgctagtattggatccagtttaattccaaactaattaagcttggactagaaccaactgcaatgaatcaaagcaatcagcaccttttacccaaaattatacagtaggttaatctagcaaaaggaaagaatacacatttcaggccagggtcattatgttagtcaattatctttttgtgcaggggacagagactaagggatcataggggaggatttattggaaaggttctgagatagctcacagattctgaagaaccagggccgttttagggccttcagtgactacaaccagaatcttaatgccacctctttcttcctactgccttctttccctctggctgtcagctttatgcttcttgcatatgtacacttctgagaaaaggggatacattttatgcctttaaaggttctagaatgggaatctgggtcaaagaatatggatcttttacaaagttcttgatatgttgccaaattgctttctaaaaaatacatactggtttagactcttaataggagtgtacgatcatgcttatttttgaaacaacctcaccagccttaaattttgtattttcataacttttctagtagaataaaatgatatatcattgaaattgttaactttttgtattatagcagtaaaagtgaattgtttcacatatttattggtatttatatttctgcttctgagatttgtctgcacattgtacttttttccattgaagtttcagtgttttcattattgatttaaactactacatgctttttgtcagatatattgaaatatttttctactttataatttacctttcatgttttgatggcttctgttgtgtagactcgaatttttcatgtagtcaaatatccgatgttgattcctttgtggtttaggccattgattttatacttagacaattattccttcagctcaagaacaagtaaatagttccctaaataaactcctagttttttaacctgcactttggcaaacttttgccatatttcaggcacatgttttagtagtcattggtttgtcttacagtgaacacttttcacatttaatatctggaatttattttagtatatattgcaagttgacaatttaacttaagttttcacagttaaccaacgtattgaatgatttttcctttacatattgcaatgtgatgtcaactttattatttacatcagttttataagtaagagatagtatatatttctggctatttattttgtttcaaagatatgctcataaacatttacactagtaatactgtgttttatgtgctgttttaatgtctgatggggcaagttcttgaattaggactcttttggttaaaagaaagaaaaacttatttaagttactttaagaaaaagggagaatatccatggaccctgtgcccagaggcaaggatctctttgacaaggagagagagctacagagccactccaattgcatccttttagctgggagaatgcttaatagctgttcactcttcccctcaccaattttcctttttttttttttaatttcctcactcttttctatttttttttaagctaatcaactgtagaatcaccgtttcaagctccaaaaggtatcctatttggattttgattggagttgcattaaacctataaattaatttgagaagaactgacatctttataatagtcattgctacccaggaacgtgtgaggacttcccatttattcaagtcttcttttatgaccttaagtaaaattttgtagttttacttatatagttcctgtccatttcttgttatggttattctgaagtatttatatcattcatttctaagccaattacaatctgacttctatctattaatcttaattcttttgttactaaaaaaaagaggggggaagtagcggaaattatttgaaggacattaaggaagctcatagaattaagtgaatagaattaagattcaaaaaaaggtggggcagatatttctctttcacaggagtgcatgcgcctgctctctctctccattgctcatgtttcatctctacatatctctgtatatttacttcattctgatatttccatcattcagaaggaaaaaaagatgttttctcattagttgcagacagaaaaattccatgcaaatgttcagattggtctagcttgggtcatacgccttctttttttttttttttttttttttttaatgagacagagtctcactatgtctccaaggctggagtgcagtggtgtgatctcggctcactgcaacctccagttcccaggttcaaatgattctcctgccttggcctcccaagtagccgggaccacaggtgcacgccatcacacccagctaaattttttgtatttttagtagagaaggggttttaccatgttggtcaggctgatctcgaactcctgacctcaagttattcatccacttcagcctcttaaaggctgggattacaggcatgagccactgtgcccagccatatgcctactattgaatgctgcctatctctacagccaggaagatgtgatgctataattagcacaacctgaatcatgtgcctgctcctgtggacagagaagcaggatttgttgccagatgtagaagagaaaggcattccgggcagacaatagccacggcatccactgacattgttgctgtcaaatttgcctgtgatcacctttttgctaattacaatgaatacttttcaactcttggaattattttagtctctgaagactttgatgctgttgacaacttcttgaaattcccttctccttttgttttagtaatgaattttcttgtgttttttcctctctttaactcctgctgttcatttttattcccttttttagaaccttttttcttttactcacccttgttattggttttatccaggcttccatctttgatttatttatcttctccttctagagtacattattctggattatctcatctaatcctatggcttcaattataacctgcccatggatgattctcaaatctcttcctccaggccagctctcactttgcgtgtttaggctcagcctctagtaataaggaactcactgatttagctacaaggaaaaatggggggttgaactatctcttggccacaggagacactgaacatattgttaatactctagaaactgtgtcctataaaatagtttatttttaaatctctgctattcttgaacactttgttgtgctttcaaaggaagaatgttttctcattatttgtacttcatttctaatgatctgatagaagccagaacaaggcataataattagaaaaaaatgctggaatgggtatctaactcaggattacggtggggatccagtgagataattgatacatgtaaaaagtatttgataagtcataaacagccatatattaccaatttggaccaaacaaggtaccctctctctctaagagatcctgagtgatttcattagtcatttaaatttaatttgatgcacaatgaatagtcatagtatataaaatacatctatttcaaccccaaagccagcatcatgttaatgggaaacatctggagaagtcccattaaaatcaggagctaggtgaaaatatctgtcacctctatttgacactattttggagacagtagccatcacaagaaaggagacagaaatgagaagtataaaaagtggaaaggaagagggcaaaattataattatttgtaaatattactattgcatttctgaaaaacttgagataactgaaaaattactacagatgataagacaattcagtaagttggctaagtataaaattagcatacggaaatgaatagtcaattcattaacgtgtattaactgttagtttagaagatataatggacaaaaagattccatttacaaaagcaatgaaaatgtagaaaatctatttgaaaaaaaaacaaaaacattaagctgcaactaaagtctcaaaagaactttgaacaaatggaaagacatagcatattcttgaacaggaagacattatcacacacagattgatccaataaaaagacaagatgtttttatttcagccaatcaaattctaaagcttatatttaaaaataacaagcaatagtatctaggaaaatgtaggaaaagcctagagtgtgaaggtcaactagcttttttatatcttaaaaagaatcagtggaataaatgagaatattcagaaacagaatttagtaaattataaaatcagccttttgaatcagtggcaaaaaaatgatttatataaaaatactattaggactaccaatagacatctagaaaatataagaaaaataaatttggatctgtatctcctaacttacctcaaaacaaattcaagttggctcaaatatttacatgtaaataaatgaaaacataagagagctagaagaaagctctaaagacttccttttaaaaaaattgggggatgggaaagctatttctaaatatgtcataacattcagaagccataacagaaatgatttaaaaatttgattgcataaaaaataaaaataaagttctgcaagataaacaaaaaagtcaaaagacaaatgacaaacttggaaaaatattcgctagttataacataggcaggtgctagtctttctaatacagagagagcatttgaaaatcagtaagaaaatgaccaagctgggcatggtggctcacacttgtaatcccagcactttgggaggccgaggcgggtggatcacctgatattaggagttcgagaccaacctggccaacatggtgaaaccccatctctactaaaaatacaaaaaattagccaggtgtggtggcagacgcctgtaatcccagctactcgggaggctgagacaggagaattgcttgaacctgggaggcataagttgcagtcagccaaggttatgccattgcactccagactgggcaacaagagtgaaactctgtcaaaaaaagaaagaaagagagagagagagagacagaaggaaagaaagaaagaaagaaagaaagaaagaaagaaagaaagaaagaaagaaagaaagaaagaaaaagagaaagaaagaaaggacctttagatatataaaatgatgctcagtcttattcacaaaaacagaaatgcaaattccaatggctggaatatcattttaaagttattgtattagcaaagatataaaggtttgattagacagtgtgttctcatacattcctagttgagtgtaagttggcaatttgccattatctcacagaattaacaatgcaactcaacagctttcctcctgggaatttatccgagactttattcactcatgtatgaaatagattactcattatagcattgtttataataccaaaagatttcacccatagagtgtatacataataatgtatccctacattgggatacagtagctatggggatcatctttatgtgatacaggatgatctccctgatctaatgttattcagaaaaagcaaggtgcggtaagtatagtatactatcttttgtttaaacacaggatgtaaaataatgtaaattgtgttttatgtataaattatcttcagaaagatacataaaaactcatattaggtgcctctagaaaaggaaacagtataactggattatagccatagagaagagctttcttactttgtaccccttttacactttctgtttcatgtgaatgtatataattctaaagtgtaaatataattaaattttaaaacattaccccattttctcatttatacagcagttatttgcttattatagaaatgataaaataactctaaggctgcaacctaaataatgattttgtctgaagcaaaatatgagcttggtgctacctcataaatggcagcacagtacaaaagtcctggagggcagaaagtgggaggactgggaggtagaacagaagtcacacttaaggcattagtctcccatttgggaactcaaacacataacgtggattttccaataccagacttagttatcttcaaaagttgttaaactaatgtcccgatgtaaccaatatctctttgagatataagcatgaaacagttctatggcttccaaaaactaccaccactgtgctcagttgaaatgctctttgtcattgactggctttcctcatcaatgtcttatcccataatgattagttactctcaaatatttatttatttatttatttatttatttatttatttatttatttatttgagacaggctgtcactctgtcacccaggttggagtgcagtggcacaactgtagctcactgcagcctcaatctcccaggctcaagtgatccgcctgcctaagcccccattgaccatcccgcagctccccacctcaacctgagtagctgagagtatagacacgtgccaccacacccagctgatttttgtattttttgtagagatggagctttgccatgttgcccaggctggtcttgaactcctggcctcaaactatcctcacgtctaggccacccaaaatattggaattacaggtgggagccaccgtgcctggcctactctcaattattaaagtcatcccctttaggctgtaaagtgctgtttgctttagtttatcttacaatatttacaattctttttgtaccacatgactcaacatgtacaaagtgcaaaaaggctctataaattagccaggtgttttggcacatgcctgtaatcccagctacccaggaggctgaggcaagagaatcacttgaacctgggaggtggagtttgcagtgagcctggattgtgccactgtactccagcctgggcagtagagcgagactccatctcaaaaaaataaacaaaaaaaagcctctatggtgaagagacttcttcccatcctttactcacagatctttcctttactcttggttatgaaggttatgcagtgcacaactctagaaggctcgatacactttgcatttataacagtatttctcaacatttgatgcaattaaaaaataattgagagtcctctttaaaggtagattatgattcagtaagtctgggatagaagctgagattctgcatttccaaaaaactctcaggtaatgctgatgctgctggtctggagaccacacctttgagtagcaagagcctatgtaattgatgcctctggaaggttgtaattccatcatgtgtggccttacatggaagccctacgttgtttgcctcccccaaggtttgcaagttttattttattttattttattttatttattttatttataatggagatgaggtttctttcactatgttgtccagggtggtctcaaactcctgggcttaaacaatcctcctacctcagcttcctgagtaactgggactacaggcatgagccaccatacccagctcccaaattttcaatattcttccaaacatgttctacgtgtatgtaagcatatacatacataaatatatatttaattatatacacatatgatagcatattacatacattgtactacattttgttctccacccattacccttccccaacttaatatgacttggagcctgttccatactggtaagtgtagagctgccttgtctttttagtgataaaatattattacattgcacagtgtaactgtcctttaggaaatgagttttcaaatggcaggaaagcaggcgacccctctgacacgcttggtctcagctctgcctccctctccctctgacacttgtcttcttgttccagcagcatctggcctgacacatctatcccacctctcccccattgaagagataaaaacgggaagacatggttacaccacagttctgtacttccctgaacagatgaccaagattagtcaaaccttgtatgtaagtgtctggtgctacagccggcagtttactgacttaatatattgcatctgttttcagctatggggtccaagaatatataaaagatacatctaggccctgttcaccaccattttacatatactagttatgatccatttggcatacctctctccattttttttttaagataggatcttgctctgtttcccaagctggagtgcagtagcatgattccagctcactgcaaccttgaactcctgggctcaagtgatcctcccatctcagcctggagtagataggactatacccagataattttttttaattattattttttgtagatgtgaagatctcactgtgttgcccaggctcatcgtgtaatcccggcttcaagctatcctcccaccttgactttccaaacttttgggattacaggcatgaatcattgcacatggccatgttatattttatattcaccattattatattataattatgttataattataatattttatatatataatatatatttatataaaatatataatattatatatataattatttttataattatatataaaatataattatttttataattatatataaaatataattatttttataattatatataaaatataattatattacaattcaccattttatattcagttattattactattggtggggtgaaagaagaactatatatttcttatgttctttcaagaacctttactaatctatttgttagtaatagcattgataaattattacagagagatggataaatcatgtgccaatgggctaaaatatggatagggccagattctagaatggctctattagtagtaaaattctggtattcagaaaatcctttaactttgcagtgccctagtatagaaccattagctgagaaacaaaagtatacagagaaaagagttaagattactaaggtacagtattatttctcattcattattaccttttaatatattaactctggaagttttttcaatctgatggtttatcattttggctgattagaagcataccttggacatattacaggttcagttccagatcactgcaataaatatcagaataaaacaagttacaagaattttttttcccagtgcatgtaaaagttatatttacattatactggagtctattgagtttgtaacagtattatgtctaaaaaaaagtacttaccttaattaaaaacactttattgctattaataaaacacaatatttattaatatattactaataaaaatgctaataatcatctgagtcttcattgagttgtaatctttttgctggaggagggtcttgcctcaacgttgatggctgctgactgatccgggtggtggttgctgaaggttggggtggctgcagaaatatctgaaaacaagacaacaatgaagtttgctgcatcaattaactctttcttttgcaaaagatttctctgtagcatgtgatgctgtttgatagcattttacccacagcagaacttctttagaaattggggccaatcctctcaaaccctgctttctttgctcatccataagaagcaactcctcatctattccagttctatcatgagattacagcagttcagtcatctttaggctccactttcttttttttttttttttttttgagacataatctcactctgtcgcccaggctggagtgcagtggcaagatctcggctcactgtaacctccgcctcctgggttcaagcgattctcctgcctcagcctgctgagtagctggaactacaggcgtgtgccatcacgcccggataattttttgtatttttagtagagacggggtttcaccgtgttagccaggatggtctagatctcctgacctcgtgatccgcccacctcggcctcccgaagtgctgggattacaggtgtgagccacccgaccctaggctccacttctaattatagttatcttgctatttctgccacatctgcagtgatttcctctactgaaatcttgaacccctcaaagtcacccatgaaggttggaatcaactttttctaaattgttcatgttgatattttgacctcttcccatgagtcacaaatgttcttaatggcatatataatggttaaccccttccagaaggttttcaatttactttgccgagatccaccagacaaattactatctatggcagctgtagctttacaataacgatagtaataataaaagagttgaaaactgaaattacttcttgatccgtgggctgcggaatagatgtcgtgttagcaggcataatagtaacattcatctccttgtacatctccatcacagctcttgtgtaaccaggtacattgtcagtgaggatgaaaggaatctttttttttttttttttcctgagcagtaagtctttacacggggcttaaaatattcggtaaaccatgctataaacagaagtgctgtcattcaggctttgtgatttcacttataaaacagtggcagaatggatttagcatcatttttaagggccctaaaattttcagaatagtaagtatgcattggtttcaaatgaaagccatcagcccctaacaagagggtcaacctgtcttttgaagctttgaagcaaggcactgacttctcctctttagctataaaatttctagatggcatattctttcaatggaaaggtgtttcatctacactgaaaatatgttgtttagtgttcctccttcatcagtgatctcagctagatctggataatttgctgcaacttttacatcagcacttgcagcttcactttgcacttttatgttttgaagatgacttccttctttaaacttcatgaaccaatctgctagcttctaaattttcttctgcaccttcctcatgtgtctcagccttcatagaattgaagagagttagagccttgctctggattaggttttggctttagagaatgctgtggctggtttgattttatatcctgaccgccaaaactttctccgtatcaggaacgaggctgttttgctttcttagcattcatgtgttcactggagtagctctttttaattttcctcaataactttccctttgcattcacaatttggctaactgatgcaagaggcctagctttcagcctaccatggcttttgagatgcttaatcgtttttagcttttgattgctagtgagggatgagtgactcttcttttcacttgaacgtttagaagtcttagggttattggtctaatttcaatattgttatttctcagggaataaggaggcctgaacaaagggagagagatgggggaatgtctgatctgtggaagcgtggaacaatcaggacacacacaacatttctcaattaaattcaagtcttctagggtgtggtttgtggtgcaccaatgcaattgcaagagtaacatcaaagatcactaatcacagatagccataagagataagacattttttattgtgtctattaaattcttctctctttttttctttattagtcttgctagcggtctatcaattttgttgatcctttcaaaaaaccagctcctggagtcatgacttttttgaagggttttttgtgtctctatttccttcagttctgctctgattttagttatttcttgccttctgctagattttgaatgtgtttgctcttgcctttctagttcttttaattgtgatgttagggtgtcaattttagatctttcctgctttctcttgtgggcatttagtgctataaatttccctctacacactgctttgaatgtgtcccagagattctggtatgttgtgtctttgttctcgttgttttcaaagaacatctttatttctgccttcattttgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcaaagctgagttcaattcctgggtatccttgttgactttctgtctcgttgatctgtctaatgttgacagtggggtgttaaagtctcccattattattgtgtgggagtctaagtctctttgtaggtcactcaggacttgctttatgcatcttggtgctcctgtattgggtgtatatatatttaggatagttagctcttcttgttgaattgatccctttaccattatgtaatggccttctttgtctcttttgatctttgttggtttaaagtctgttttatcagagactagtattgcaacccctgcctttttttgttttccatttgcttggtagagcttcctccatccttttattttgagcctatgtgtgtctctgcacgtgagatgggtttcctgaatacagcacactgatgggtcttgactgtttatccaatttgccagtctgtgtcttttaattggagcatttagtccatttacatttaaagttaatagcgttatgtgtgaatttgatcctgtcattatgatgttaggtggttattctgctcgttagttgatgcagtttcttcctagtcttgatggtctttatattttggcatgattttgcagcggctggtaccggttgttcctttccatgtttagcgcttccttcaggagctcttttagggcaggcctggtggtgacaaaatctctcagcatttgcttgtctgtaaagtattttgtttctccttcgcttatgaagcttagtttggctggatatgaaattctgggttgaaaattctttcctttaagaatgttgaatattggcccccactctcttctggcttgtagggtttctgccgagagatccgctgttagtctgatgggcctccctttgagggtaacctgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatggcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcatcaaagtcattctccatccaggtttgttccgttgctggtgaggaactgcgttcctttggaggaggagaggcgctctgctttttagagtttcccgtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgccatgtgaggtgtcagtgtgcccctgctggggggtgcctcccagttaggctgctcaggggtcaggggtcagggacccacttgaggaggcagtctgcccgttctcagatctccagctgcgtggtgggagaaccactgctctcttcaaagctgtcagacagggacacttaagtctgcagaggttactgctgtctttttgtttgtctgtgccctgcccccagaggtggagcttacagaggcaggcaggcctccttgagctgtggtgggctccgcccagttcgagcttcccggctgctttgtttacctaatcaagcctgggcaatggcgggcgcccctcccgcagcctcgctgccgccttgcaggttgatctcagactgctgtgctagcaatcagtgagactccgtgggcgtaggactctccaagccaggtgcggaatataatctcgtggtgcgccgttttttaagcccgtcggaaaagcgcagtattcgggtgggagtgacccgattttctaggtgccgtctgtcacccctttctttgactcggaaagggaactccctgaccccttgcgcttcccaggtgaggcaatgcctcgccctgcttcggctcgcgcacggtgcatgcacccactgacctgcgcccactgtctggcactccctagtgagatgaactcggtatctcagatggaaatgcagaaatcaccgtcttctccatcgctcacgctgggagctgtagaccggagctgttcctattcggccatctttgctcctccctgcaactaactccattcttaattggtaggtgattcttatgggttgaattgttttcccccaaattcctatgctgaagttccaacccctagtacctcagaatgtgactgtatttggaaatagggcctttaaagaggtgattaagtgacagggtgtggtggctcacgcctagcactttgggaggctgaggtgggtgattgcctgagctcaggagttctagaccagcctagccagcatggcaaaaccccatttctactaaaaattcaaaaaattagctggctgtggtggtgtgcgcctgtagtcccagctacttggcaggctgaggaaggataatcacttaaacctggggggcggaggtttcagtgagccaagatggcaccactgccctccagcctagggaacagagtgagactctgctcccctccccccgccccacacaaaaaaatttaaaaagaaagttagcctggcatggtggtgtgtgcctgtagttccagctaattcggaggctgaggcatgagaatcgcctgaacatgggaggaggaggttgcagtgagtcaagatggcgccactgcactccagcctgagtgacagagtgactccatctaaaaaaaaagagaaagaaaggagaaagaaagaaagaaagacagacagacagaaagaaaaagaggtgattaagatataagaagaggaagtttggccaaagagacacccaggatgtatgcacatagaggaaagatcatgggaggatatggtgagaaagtggtcatctgcatgtcaaggagctaggcctcgggagaaagcaggcctgctaacactttgatgttggatttccctgcatccagagctggaagaaaataaatttctgttgtctaagtcacccaacctgtgatactttgttatggcagctgtagcaaactaatgtagtaatagtcattgaaagattttatgcagggaagcagtcattttgatggcattgtgaaagcattggaaagcagtgagatgcaggtgggcagatcagttaggatattgcatcagtctaggcaagagatgggaagggcttgactaaggcagtgaccatcggagtggtgcaatgagatatgagagatagctcagaggtaaaaattaatggagagagagtggataagttggcaacattttccaggtttcttgctcaagtggctgggtgaataatatgccatcaaggcctgaagtaagaaatataggaagataattcagttttgttttcaagataatgagtttggttttttgagatgttttcttggagtacctgtgggacatccttatggacaggttcagtggtagctaaatatccagatgtggagacgaggagataagagaggctacagacaataacttgtgagccatcagcaataataacagcaataatagtagttatggttaacacttaacctagggcttatcaggcgccaagcaatattctgaaccctttggatgtcacatatccttacaatgacctatggtgtagaaactactgttattcccattttaaagatgaggaaattgaggcagagaaaaaatacccaaagttactctcagccaggaagtgtagagtcaggctatgagcccatacagtctggttttagggcatgtatcttgacaaggtgatttgcctcttcatgtagttggtagttaaaattatggaaaaatattcagatcccttagaaagaagatttctatagggtgagaagaaaagaagtcagtataaaatctgaggacatttcaataccaatatgtagagatcagcagaaaaagaagatccgaagagacagcaacagtttggttagaatgatggaaggaagaccaagatgagaagtggccaacagtatcaatgccacagagataccaagtaacagactcagaaaagtgttcactggatgtgaaaagtaggagaaagctggtagccccagcaagggtcattttatttgggtttgagggagaaggatcagaagtcagatcatagtgactggagaagttagaaaaagagcatacagaaataaaagaagaattatggcagagaaggatatgagaggcagacagtcaaagagaaagagagagagagagagcaatttgggcaaaaattatggggacattccatgacaagactgtgattaaaatggagtggttgaacatgttcatagaccacgggaaaggagtcagcagaagaggggaggtttaagacagagaggaataatttgagaagggatgttttagagaaattagagaagtagaattaagagcacagctggagagctaaggaggctgtggagatgtttggcaatggcaactgaaaatgatggcattcactctgatgttcttggtcttctctgagaagtacggaagcaaagttatctgaaaaatgtggtagaggagaatgggttgggagacaaccaaagactagtaaaaggactgagaagtagcatgaagggctcaatagacaggagaaacattgaaattgtagtgtcagcaccacttaaagatgtatgatagtctccaatgtgctgagttctgtaggaggaagagtagacaacatgtattataagattgtctcaagactgggttttgcagcaggctgtgatagaaaaacctgacttggttgtgaggagtggggaaagggaggtgttaaaaatgagggaatttaaatggttgggaggcagttgttcacttgatgggccaaggagcacagactaggcaggtaattaaagtctaagagggaactgttaaactgagatattctcagtgtccttctttttctcactatctctcttcctactgttttacattttgtcacactgggaaaaagaggtcaatatttagaaaatcagccattgtgtctaattttcatattgctaaacataggatacattgagtacatattgctgcaagccctatggaagttaattcagtaataccagattacaaaggcatttacacttagactcagaaattctacttctgtcactttatcctacagatatacttaggcaggtacaaaatgatgtgggcaaaagcaccactgttattagtaaaagcttggaaacctctgaaatggccatcaaaaaatgctgctgtaaaagaaagaatgaggaaattctttatatattgacatgaaaagataaccaagattaagtgaaaaaaaggcaaggtacaaaacagtggtagagtatgcaccttttgtctatgaaaaatggggaattatgaatatgtatgatatttgccttagttgcacaaagaactactgaaaatatctacaagtagtggatgggacatgatttcacagtaaactttttatattgtttttattttttaaatgtggctgtgttgctaaacataaagtggaaatatatgtgtgtgtgtgtgcatatatgtgtgtgtgtgtgtgtataattacaagctacattgtgatagccatggagatgcacagtccagatcccattacaaggaattaattactgcccagctgtggagaacgtagtctgcacaaaagcctccagctgtcagctcctttagggtcagcctcgggggtaaagagccatcttagccaaagtcatgcccttcccaaggcagcttacatttggtgactgagagaagcaagggaataaagactgggacattttagtctgggacaactccgaagggcaatattagcctcctaagctcccagccagggtgactggggactttgtccagcctgcatctggtttcagcttttttcctgctcaattctgcttcctctccccactccccaacacgtttgacagatatttatacctttttatttctatttttaaatttttttttttagaggtgggggtctcattatattgcccaggctggtcttgaacacctgggctccctgccttggtctcccaaagtgctaggattacaggcgtgagccacggcacccagccagatatttatccctgataaacgtcttgcaacccaaactttggctcagagcctgcttttggaagagtcaggaatatattttgataacattctaaagatttagttttcaatgcatagtatacttaatagaaaaatcaagacatttaaacttaaaggaataattcaaataacataatagaaaattatttgtatccagttgtcttgagtctaatgtatttcaatataaccttttaaagttacagttttaacagtaacacttataatgtatcttattctcagtaaacaaactataaaacaaaaggttttttacttctgataatatcaaggaacagtggctatgtttgcaaattaaattaggctgggtgtgatagcttcatgcctgtaatcccagctctttgagaggctgaggtgggaggattgcttaaagttaggagtttgagaccagcctgggcaacatagtgagactgcctctacaaaaaaataaaaaacaaaaaattagtcagacatggtggcacatgtctgtattcctgagctcaggagtttgaggttacagtgagctgtgatcatgcactgcactccagcctgagtgacagggaaagaccctgtctgaaaaaacaagcaagcaaacaaataaataatataaaaaattaagaggcactcttttccttaacgaaatatttctatcagcggtccatattacctactacatgtatgcatgtgtgcatgaacacacacacacacacacacacacacacacacatacacacagtttatgactatgtttgcaatcttccaatctatcatctatccttaatcacttaatagacattttattaaatgctatgcatcaaaaacaattctaagacatgggccctcttttcaaagaattcaatatagttgccacttcaataatggtaccagaatgcttttaaaattcttgtgtgaggaaaacaatacgtaacctcaagcctgagactgcttcacgtatcacagtattttctgaaagactttccttttcagacttctgcattttccatttctctaaaacacattttctgtaaaaaccatctcaagtatccttacaaagtgtactttatatgatattttctcccaatcttcatacttgaacaaataaacatgtagggattatgtttctttctattctttattaatgtcatgaagtaaatcactagtggatgatgtcttttaaacttgttttcccagttacctattttgtgttgttattttgtcttaatgagatccactgagacagtaaatttcaaagcacttttccaacagtgaagtgaaaatatcagcattgttgtttttattaattattaatgaaatgaatgtattaactctgttttctcctcaagattctgcagaaaatctaattttaaaagttctatatttaaataacatatgttttccttttaaaaagttctatatttctagacccatatataaataaaaaatagtttatagtattaaatttatatctatttgtgagacaaggttgactaagtgatctgacatattgactaagtgatctgacatctagtatgaccatagaaacacctactttattaaaagaggtaaaaagtaatagttcaattaatactgattctatttaatggttcaacaaatcagacctcaattagaaagagctattcatttctcagtgcatattatctactaagcattttaagggctccaaaaacaagtagggcttcatcagtctttctgaagagtttataagtttataatatattcaagaggaataaggcaaataagcaggaagggagagataaatcccataaagaaggaaccttatagtggagagcttcaaatgccagagtgatttcttttcttttcttttcttttctttcctttctttttttttttttttctcatggagatgaggtctcgctttgttgaccaggctggtttcaaactcctggcctcaagcaatcctcctgacttagcatcccaatgtgctgggattacaggcgtgagccattgtgcccggcccagggtgatatcttaataatggtgatggtttcaagagtttatacatgtgtcaaagcttattaaattgtatactttaaatacataaagtttaatgtatgtcatatttacctcaataaaactatttttcaaaataccagtttttggtattttgaaatgttatacatagtggaaaacactgcatttttttaaacagagaaatgataaaactagtattctgccttatgacgaataagttggtggtaacattagttgacttaattaaaaaaggaaaatgataaaccagggtagagtactccagtatgggggtattctgctagattaagtaggcatgttgattgttaatggcttaatagagctagagttactggcttagagactgctaaagaaaaagaaaaaccttgcttgaagttttattaagactgagtcccaagagatctaaagacctagaataattgtataggtttccaagtcttatagaagagtatgatagtgatgatagtgaaaaatataaataccttctaatttgcaaagccttttctgggaggcagtgactcccagaaaatgtaaatactacatttacactgcttaggacaataaagcccaactctttatcttttgtaactaatgaatgacgaatcagctaattcatctctttatctcattctataataaaaagattagtgatttcagttcagtcacttcctcagaattgtggtctgtattgtgtcaggacaagatcaaataagtgcatatccaccttttatatgtctatacaattatttgattctagaaatatgagagtaaaaggaaaagagtaaatatgttggtgaaaagtgtgacagcacaagcctaagcaggagaacaaaatgaaaagtagttcttaaagggaataaaagttctttggatgtttgcttttcccgggttttaatctcttgttacccagaatataattgaaatatattattttaatggctgggcacggtggctcacgcctgtaagcccagcactttgggagggcaagacaggcggattgcctgaggtcaggagtttgagaccagcctggccaacatggtgaaaccctgtctctactaaaaatacaaaaattatatattttataattatatatatatattttagacggagtctcgctctgtcaccgaggttggagtgcaatggcgtggtctcagctcactgcaacctccgccttccaggttcaagtgattctcctgcctcagcctcccgagtagctgggataacaggcacccgccaccacgcccagctaatttttgtatctctatctctggttgtcactagagatctggaatcaggtgtgggaaaggatgggtcagaagactgctggcttttgtttgcttgtttgttcatttgttgttaaaaattctgtagtactatctcattgtttaaactatttacccatattattatgcattctataaagtgattatttggtgaagaccataaatattacatatagcatgaataaaaaaataactggctgggtgcagtgtcttgccctgtaatcccagcactttgggaggctgaggtggaagattgcttgagctcagaagttcgagaccaacctgggcaacacgacaaaatcccatctctactaaaaaatacgaaaacagctggaagtggtggtgcatgcttgtagtcccacctacttgggaggctgaggcaggaggatcaattgagcccaggaggcagaggttgcagtgagtcgaaatcactcccctgcactcaagcctgggtgagagtgagaccctatctcaaaacaaacaaacaaacaaaaactgtcttactcttactcagataggtacttatgatttggaatgaagtttccaattagagcttctatacggatttattatatacttaaccttaggcaatttagatggaagagaagagggtgttttctagaaaattatggtgatggtttaaaatgtggttccagtggtggcaacaatactgatgttggaggtgtctgcgaagagtttgattaaaattgtttaatgtatatgagtgggaaaagcacatcaattggggaacattctacaatattagacaatatgaaattgtaaacatgtatgtgtaaataaatccataaattattttttgactatgtctttgatattcctgaaatatgaaatattctagttggcaaaaacaaacaaacaaaaaaacccacaaaaactacttttgcatcttttcattaggaaaaaagcgattgatttaaatttgaagtcactttgtattttggcaaatttcacagtttcctccattgttctctgaagctactaataattacatttaagtcgaatttcgaatctaccactaattagtttctctttctttgtctatcttataaagtcactaaaatcatcctcatgtgaaatgcacgtgttatagcttgtctcatattatcatcttgatcaattaaaaattaaaattttcactactcaaaatactctgataagtaatcaaaggctatatactttaggaaaaaactaaaaataatccactcgtttatttgagattgaaatggacttataaatcttgttggcagtcttaaagctaaagcaaagtctacaaatgcattaacccagaaggaagaggacaagtttgtgccatataattttataattgggaatttaaattgtaaaagaaaaagtacccaataaatggcagatctcctttgttttaacctcatccaaaattaatcccactttttgatcacatccctgacaaaggaatctttctttctaatgctgcaatattagcctggggttcaggaacatccctgcgaggacagagaggaattacccaggaaaccactgcagaaattccaagtatcttttaggtgctttacagttgacacctgaagacctttctgacatggtcactattgtgacaggaataatactgcttcatggtcagtctgtggtgagattatgcgtggaaaaccttggatttccaaagaattaagaaattaaaaacaacagcaacatcaacaaaaataaaaaccagatatgaaaaaaaacctccctaatgaagacgggattctttcttctttgcataccatcaaaaagatcattctggtgtagataacagaagtggagttgaatcataattttttttttagttgattatagatgccactagaaaaggtttaagcgtgtttggacagggaaatagaagtattcttttacatttgctgaaagaagatctattatctctaataatttctgaatgaaatacaatttaattgtagtttcctgtaaataaatacatttccacatttcatacggcagagaagaaatttggttttgtttgcatctcatttttgtatttttaagagtgaagtgtgaaattgtaatgacaaatttccctttgttttcctctatttgagagttcattgctgaatacttttaacgtttaatcataagggggaaaatgaccccagaattatatgatctttaatgactccattttaacaactagatacaaaaagagaagcaaagtgaaggacatcctcttaacccattcagatggaaatgtgaatcaagtggaaacattttataaatgtttattaatataagcaagttgctttatttactagcattattatactgtgcaataaaatactccttgtggttagaagcagttacaaacagctaactattgttttcctatttccattttttatgttctgatatcaggcaacatctacatcaaaaaattacagggggaggaaaagaagagaaattaggataggctataaagattgtacaaatcctaaatggtatgattacagggcatgatggccactgaatagatccattagtcgtaattgaatctgtcaggagccaggtaaatggctgtctctgaggaggtcaccttccacatatgaactggcctacagcttgtattagccttgtcaggagattgaatcctgacttatctgtagaaacctttaaaacaaataataggaatgaagtagcaaagctcaaaagtaacaacattctggacggaaacaaaatgcatagcataaggagtggtgatcacaccagacaaactttattgcccatcctgttcccaggctgtgtggcacgctccccgttttctcctctaggttcacggttagcctccccacccatctctgggctgacattttcaaaggactgcatcaaaggtgattccttgccctgtgacttccataggaagtcctgtttggagaccggaggatggaagagaaagaatatttatttccctgctcttggatatttaattccctggtttcttccttcttgggggccttgtgcttcaccaaggaccatagctggtctttggagtaaggcaagtgaggtcctagggtgaaaaaaatttaagggggtgctcattctcagggttgtgcaaggggaggatcggcactggagagaggccctccttagatttattttgtcactaattccttacactagcccttcctttaattgagctagtttgaagggattctgttccttattttcaaagcagcacaaaccaaaatagcaaaaaaccagaagcctgagaagcacttggtgaaaacttggttattctaaaataattcaggattcttgggcccagaaacttatcctcgtcaagattggatatgtgttgcttcataaattgtaaggccagtgaaaaaagaaaacatggcacagtgctgtggctcatgcttgtaatcccagcagtttgggaggccgaggcgggcagatcacttgagatcaggagttcaagaccagcctggccaacatggggaaacctgtctctattgaaaatacacaaattagctgggcatggtggtaagcaccctgtaatcccagctactcaggaggctgaggcatgagaatcgcttgaacccaggaggcagaggttgcagtgatccaagattgtgccactgcactccagcctgggtgacagagcaagacttcatctcaaaaaaaaagaaaaagaaaaagataatacagggcgcccatgtaagcattactgaaaatgtcaagaaagcaacagcagagcattgaagcaagcacaggaactttcttagtgtgggttcctacatgactacataggtcatatactcatgaagcccagattctgagatatttgcaaatgaaatggttaatcattgaggaattgtgagaactgaaaaagtattagaaaataaaattaaaagtcatttaaaattttgcaagccctatgatggcagcatgggtttattatgcatctttttaacccatggtgtttattagagcactttctacatagtaagaacttagcattaacaacaataatatctatagttactgaactcttattaggggcccaaggcctggtgcacagtaagtatttatttgttgaagtaatgaatgggtagattaaatttagatactggttaagggctttatatgaataatctcatttaatcctaaaaatcaatcctaatgatcaataaatcctcatttaagcctagtgaggtaaatatcattagtatctcttgaattagtctgttctcacactgttataaagataccacctgaaactgggtaattataaacaaaagaagtttgattgatacagttctgcatggctggggaggcctcaggaaatttacaatcatagtagaaggtgaaggggaagcaaggcacatcttacatagcagcaggagagagaatagagaaagggagggagtgtcacacttttaaatcaccagatcttgtgagaatgcattcattatcgcgagaacagcatgggggaaaccaccaccctcataatccaatcacttcccaccaagtccctcccttgacagacacgtgaggatgaccatttgagatgagctttggggtggggtggccaggggacacagcgccaaaccatatcatctgtattttataataaggaaccggaagcttagagagttaatttgcccaaggtcacagagttggttaacgtctgaaatttgtatccctatttctatgattccaaagtctaagatcttaaccactctgcccacaataggcactctgaagaactgaatgatttttggattgtctttgggcattaactgagttgtacctctaacaactctattaacttgatattaaaaaatagcaatccttattatgtaaaaattttaaatcccagctagtaaatactaactgtataagagactctgattgtctacagaacattctctccttagaaagacatatttttagtcttatattttattacatttctgatcttctgtaataagacaatgaaattattatatcatggatataatataatataaatgacggattgtgtcatggatacatacaaccttataaatatgtcaggccaattagaactcttagtcttatattgaaatgtgcaccgtagataaaattacatagatacaaacatctatatattgaactctcggtggcaaatttcaagaactggaagccttaaaataaagaggaaaaagctcttgagactggaatatgccttagtattagtgaaaacaaatttcacttctccaattattgtgtggacaatcctgttatctcataccagtcttctaaaatccttaagcttgaagaatggcttcagcccagaacaagctttctctaagtggaatgcaggaggatttgagcagccagattcaaatgtgcactacaggagagcagaatatctgtgtgtatatggtgactgttcagtttccacctattggccgtccttgcaagggaggcatcattctctcacaagatagattagtatggtaacatgtaataaaagaggagagattaaaaagaagaaagaatgcagagagaaaagagaaaatgagttactgtttaacagatgctggggcaaatgattatgctcctggcaggcaaaaaaagggcaaaaagtttcctgtattgctccctaatacagtcacctttgaagatgtgatgtgccgactctctcaaaactaatctgacatacacagacacctaaatcatagctgtcactatggagtgctgccgctggcttgtacaggctcctgagagctaattgtgtacacctctttcaaattccatattcagggacatcaggttcatagtttgaatttggccgtaataggaatatttacaccacagaaatcagcaaccgttgtagtttttttttttttttcctccctggagagcctgtttaccagcacaccactgactgtagcttataaagacaacataactccatagtgtgtacatgggatagggaaccatactctacttttgtgtgaaggcaacaaataaggaaaaatgaatcagtaaaactcctgcaaactttatagaagactgttccaaaggtcctgctggcatattgcagtttttaaaattcaactacaagtgcattgcaatgtcattcagaaggttgaattataattggcatactctgtagaagaagtgagaagtatggtataatttttataaagttttccattgaaaattaatttttcaaagctatgggagctggtttgactattgagcatctttattgataaatatcaagccctatggcctttctgcaacacatatttaagttaaacaaatgaaatcaataagttataacttaaaaataaattattattattattattatttttgagatggagtctcactctgtcgcccaggctggagtgcagtggcgcaatctaggctcactgcaagctctgcctcccgggctcacgccattctcctgcctcagactccagagtagctgggacaacaggtgcccgccaccacgcccagctaatttttgtatttttagtagagacagggtctcgccacattggccgggctggtcttgaaatcctgaccttgggtgatccacccaccttggcctctcaaagtgttaggattacaggcgtgagccactgcgcccggccaaaaataaattatttttaaaaataaccaaagaaccacaggaaaaacttatgttacttaaaatattattgtttagctggttaaacaatctaggtcaccaacaggactcaccaaacttcagttccatggatttaaatctatttacaagttgcttttatttaaataaactaatagtttctaatacataacttattgaagtaaactgataattaggcatcaatttgtattcattttggaagccaatggacatttttagcagtaccagcagtaaagatactcagattttattcccattgcttggagtatgcagtggcaatgaatgtctgaaaaccactccagaatggtagggggataaattgtattttggggaagattttggccagtatagacagaaatggaagaggaggcctagttactcttgtttgtttttacccttggttttttctattttttgactattacaaataatgctgctatgaacattttaatacaagcttttatgtgggtttatgttttaatttctctaggatatatacataggattggaattgctaggtcatacggaactctatgcttaacactttgaggaactgttgaactgtttttccataacagtgcaccatttttacatttccatcgacaatgtgtaagggttctaatttctctgcatcggcatcatttattgtcttttttattataactatcctggtagtggtatctaactgtggctttgatttgcattctcctgggggttatgatattgagcatcttttcatttatttactagctacttgtatatctactttgaagaaatatctatacatttttatttaattatacttaattaattattattatttttttgagacagggtctcactctgtcacctaggctggagtgcagtggcgtgatggcgtgatctcggctcattgcaacctctgcctcccaggctcaagcagtcctcccacctcagcctcccaggtagctgggactacacgtgcgtgccacacgtggtgtctcaccatgttgccgaggctggtcttgaacccctgagctcaagcgatctgcccacctgggcctctccaagtgcttggattacaggcgtgagccaccatgcccgactcctaattaataaaattctttaattagattgttttttaattatcaagttgtaaaagtttttctacattcctctttactcttaattagttgaaaatttgtcaattgttctttaaggtaaaaaggctaaatcaagaccttatgctaccagtttggataagaagcgaggcactgggtctatctgtagtggtatgttgcagtcagtttgtcacaagagccaattgttaaatttcaggaactttgcaaactacttgttaaacacagtccttattaaaaagcaaattatatcaacttacaattaaatatcttatattagtattagaaataaatatattagatgttctaagcttattacttctgaattatttttctacattttattattatttatgctattgaggttatttatgctattgtctctatggtggaaatattatacaattatgtgtaagtgtacacctcttcccaactccatatggaaattgaccatgtgggagtactgtatttataccatggaagttggcaaacactacacatcagcttctcccctatctctttccaccaagagctgctaattaaacatctgtcagcgcaccactggacaattaggcctggatattataaagatgttccaaaggcctaattcttgacagagaatgtaagcagaagagaattttttaagacccctagcaacccttgctgagagcacatctttgaagtccaggctgtggtgccactttggaacaactctcatgaagttgcatcaaaagatactggtcagctttgcctgctaagttggagaaagtaggccatgtgttctttgaatgtctggaggacgatgatgattttatttgactttgctctgtataatcagtgtttagcatggcgttgagctgatactatttactcagtaatatttgttgaataaatgatagctgtgcttttcttctgccccatggttataaggactgaaatttaagaagcctgattgaatagattccttcaaaatttccccccaatacctacttaataagttcctgggataagaggttgtctcagaatccagggtgagatggggtagagttggggcagaactatacctatggaagcagcaagagaacaaattacttctgtggtacatattctgcaaaaatgcaagagccacagtcaagggcaattgacttcttccttgtaagaccctctttttctggttaaaaaagtttttcttctataaatctagttctctaagtctcataggccagccctgaaccacatggccatgacttgctgtaaggaagtctgggaaagtatctggcaaaggggaagaagagagccatggttggcttaggttaggggtaggcaaactatagtctgtgggtcaaaactggatgatcacctaattttagaatgttttcaagctaagaatagtttttacataaaaatatataccagagcatagccatcatgtcaaaacaagaaaagaagagaaaagtgaactttttgtgtcatgcttttaaggcacagtggattgtggattattttgttatcaaattggatgacaaagtatgtgtttattgtgcagtgatactatacctgtactaaaagataatatacatcaatattcccagattcatcacaatattcccaactcacagggagacaatggtcagaaaatgtgaaaatttacaatggaaaacgtcatcacagcagaatttcttcacaaaaataacaaaagagttgaaaccaaagtaattttctgagtggcttctttgttggccaagcaaagaaagctgtttactgatgatgagttaattaaatcatgtttgatcacagcagctgaaaaaattttttcccaagaaaataaacttgtttcagacgattaacctttcagtgagatctgttgtttgaagagttgaagacactgggagcaacatcaatagtcatgtacaaaacaaggtagatgattttgagtggttttccttggctcttgatgagttgacaggtattaccaatagtgctcagttgcttattcaaggagtcaacgctgagtttaaagtcactgaagaattagcctctatgaatcgtctgcgtagaacaactatgggcaaatatattttcaaagatgttgggaaaacattaataaaacctgaagtagaatctgttaagatgccttataacttatggtgataaaaatgtgtatggagaagaaaaagcttagttggacaaattaataaagcttgtgaaaatgtgagagacttaaagcccattgttacttactatgctgttcatcagcaggtaatttgcagaaagtgtttgaatctattgtgtgtttctgacccagaagttccaatggtgaacttcatttactctggtggacttaatgatcaattctgcaaacttttgtcaaaaatagaagctgaatatcccgatttgccctatcacacagcagttttatggcttagcagcggtaaagttttgttgcaatttttaaaactcaggcctgagacttctggaatgagaagaacctccctcaattactgttattgaacatgagtggctttgaaaattagcttgtgtggcagacttcatcatgtttctcaatataaaattacaaggcaaacagagcatatgtccaaaactcacattatggtaaagtcattttaacaaaaactaatgctgtttcaatcacaagtaatgtcaacctgcttaatatagttcctgtgctgtcaaagttttaaaaagaagcaagagctccattcccacaaacatttgcaggagatatattttccaaaatcaaactaaagttccaatagcatttttggatttcaatgcaagtggaaaggaaattttcaaacatcaaaatccatttattaaagaagacacagataaatggaaagacatcctctgttcatggattggaagaataccattacaatgttcataccacacaacatgatctacagattcaatacaatccctaaaaaattttgataatactatttaagaaatagaaaaaaacaacataaaatttataacaaaccacaaaaggccctgaatagccaaagcaatcttgaacaagaagaacaaagctggaggtatcatacttcttgatttcaaagtacatgacaatgctacactaatcaaaacagtatggtactggcataaaaatatacagataggccaatggaacagagcagagagcccacgaataaatctatgtatctatggtcaactgatcttaaacaataacacacaaggatcgactctttattagatggtgttgggaaaactggatattcacatgtaggagaatgaaattggacccttacctcaccccatgtgataaagtcaactaaaacagattaaatattcaaacataagatctaaaactgtaaaattactagaagcaaagataggaagaaagcttcttgaccttgttctgagcaatgattttttgaatatgaccccaaaagcacaggcaacgaaagcaaaaatagacaggtgggattgcatcaaaccaaaaagcttttgcacagcaaaggaaacaacagaattaagagacaacttacagaatgagagaaatatttgccaactatttatgtgataaagggttaatatagaaaatacaaagaattcagcttaatagcaaaaaaaccaaataaccttattaaaaaatggactaaggacctgatagacatttctccaaagaagacatacaaatggccaatagatataggaaaaaatgctcaacatcagtaatcatcatacaaatttaaaactacaataagatataacctcaaacctgttagaaaaggtaacaagtgttaaggatgtggagaaaagggaacacttacatgctgttggtggaaatgtaaattggcagagccatgatagaaaaccgtgtggaggtttctcaaaatactaaaaaatagaactatatctgatactgcaatcccacttttgagtatacctccaaaggaaatgaacctggcatcccaaagagatatctgcacttttgttcactgcagcattattcacagtagtcaagatatggaaacaacctgtttgtcaaaagatgattggataaagaaaatgtatgtatgtgtgtgtgtatatgaagatatattgaagtttttatatatcctttgctttattgaatcctctcagcacctccaataattaaaaacatatcaggaagaacaaaaagagacttgaggcaaatttactctctggtccatttcagaaagaaattgctggcttagatcaaacatattctatcccttggtgctgggaacattactgagtcacataaaaatttggattatttttagcatggggattacattgaaataatgtatgtcaatattagtaaggatctgatattgtcttgttattaagaaaagtggttgtagttattagagatacatggctacatcattcttattgcccaagctgaccttgagcaaactaccaagcatgtgaatgaggccatcctagaccagccaagctttaagctgactgcagacatgtaaagagatccaggagggaccagcaaaaccagcctaaatatgaattgcctaggaaaccacaggatcctgagaatgaataattgtttgtgattgtaagccactaagttctggggtggtgtgttacacagcaatctctattataggtgaccaaggtaagtgtgtcagatattctctttttgccccttcacagtgctgcaggaggccgacctataactgcagcacaggcttcccttgcttcaggagatcaagagagaggagaatgagggaagtgaagatagtaattccctgaaccccctccctgtagcatcactgtggactggctgtgttacgtgaccaaatgccccaaacacagcttctttgtgttttgtaactacactctctcctttctgctttcagcttaggcgtgatttgggggccccaatgttactgcgtctcccttgtgatctttttaatccctgcccatacctctgtttatagtcttttattaaactcttcaatgtttcctagtttgattgtaccatctgtttcttgctgggaccctgactgatagagtaggccttatccagaaggtaacatctcagcaaagacttgaatgatctgatggaatgagtcacaaagatatctggggagaaatgccaagatcttgcagcagccaggaggccgggtgagtgagctgggcaggagtgtagaagacaaggtcaaaggggcaacagacagtctgtgtatgtgtgtgtgtgtgtgtgtgtgtgtgtgtgtgtgtgtgtgtgtgtgtgtgttggggatggaggtgtgtggtgcaggggagggagatcatgtatggccctgttggcttttgtaagaactttcgcttttacttagaaagaaatggggagccattggagactcgtatatctaattaaatctaatagattgctttctgtgatgtgctgacactggagctctgtgatttagtactgaatttctcctcccagtcttcgtgcctgatgatgaatgggtgggcgtgttgagccagcccagcatgcttgggcctgagttcaaggctttgtgtctctctcctgatgctgtgggtgacatgaccttccttacagtacaggattcagactacagtgtcttttttttgttagcatattcttttcagctctgttaatgacttgggagtgggcacatttttcttactctctttttttttgttgttgttaaagtcagtaggcccttctacactgacttcaaaatgtgtgcttatctaaagggtcttatacaatagagaactgcttaactacttcagtggaaataatacaaggagttgaacagaaatactatctgcctgcctacctcttaaagacggtagtttgtcttaaatatttaaaaggcagagttttgcatgtacaatgtctagaaaatacagatttgaaaggtgttttaatccttcaagtgaaatttgcgtctgagctgggccttctggaattaagtctagcgcaccctccacaggttacatgaataaaggtgattctcttgtaacccctatgaaggaccaccctctctctgctgtttctcagaaatattcctcaggctgaaagtcagtgaaccagctgtagagagctacaaacatctgcatcagatgtaggttcgcccaactaagttaaactgatctttcctaagttatagctcaatcaaaatttaactataaattgtagctacattccttcaggctccattctttgctttcagctcagaaggaaagtaagctatttagttaacgtgattaattaggcaggcagaatctttttcctcctggctaagaatataggtggactattagaacctgttctaatgttttttgtccggccttcaccttaatttcttttacaatttgttgttattgtccgggtgcgatggctcatgcctgtaatcccagcactttgggaggctgaggtgagcccaccacgaggtcaagagatagagaccatcctggcccacatggtgtaaccccgtctctaccaaaaatacaaaaattagctgggcatggtggcgcacgcctgtagtcccagctacttgggaggctgaggcaggagaattgcttgaacccaggaggtggaggttgcaagctgagattgcgtcattgcactccagcctggcaacagagcaagactctgtctcaaaaaaaaatttaaattttaaaaatttatatcccagtgcataaagcaagctattcaataggtatgcagtagaaagaggataggactaggagtcagggaaccagggttttagtccttctaaaacatattagcagctagccatggtggcttacacctataatcccagcattttgggaggccgaggcgggaggataacttgaggccaggagttcaagaccagcctggacagcatagtgagacttcatttctatatatacatttatttattagaatgtagtagtagaatatatgtgtatgttagccgaacactgtggtgtgtgcctgcagacccagctacttggaaagctgaggtgggaggattgcttgagctcaggaggtgaggctgcagtgagctatgatcgtgtcactgtaccccagcttgtgtgacaaagtaagatcctgcctcaaaccaaaacaaagccaaaaacaaaaaacagccctgcccaaccacagccccccacaaaaagcaattagtcatatgacattgaagaattgaagatgaacctgtatccttttagaattttagttcccttctgtgtaattggcttgattagattaaatcagtgaagcgtaaaaaaattttgagttccaacataagactttaagcttactaaaataaaattcccaacaagtataacctattatcatttcatatgagaaaacttctattttctttttttaatagagatggggcgggggccctcactgttgccctggatggtcttgaactcctggcctcaagttatcctcccacttggcctcccaaagtgctgggattataggtgtgagccatcatgcccggcctgagagggtacttttaacattaaaacaaaacaaaagaacaaagcataatctcaggaaaaggacagtcctttaaattgaataaatttatttttatgaaaacttaatacattgtccatattttttaacttcagaatttgtcagagaaaactttgtcatgaactggcaacttctgagatcctttctagttctaaaagcctatctctctagtcttgtcaaaataaatctggtggctgctgacttggtctccagaatgagctggctccataaggctctagaatacgtctttcatcttggtatctcctgtgcctaccacagtgcctggtatagcattagattaaataaattaaaaggtgaaatgatccctgctgaattgcagttcctgtatggaaggagtataccccagaaggagggggtgagcccatggacttccagcttaaccctagatctgcagtaaaagcagtcaaatcggttctaggctccaagtttaatggtcaagtttctcaatcctgcccaaaatctgaatctaggataggtgtctgctgtggcctacatgtttgtgtcccccaaagttaatgtgttgaagcctaaactccaatgcaacaggattaagaggtggggccattgggaggtgattaggttatgaggactcctgtcgtgcccttataaaagacgcttcaggtaatctatttccccttctatcctgtgatgatacacagaaggcaccatccatgaggaatggaacctcaccatattccaaatctgctggcaccttgcttggacttcccggcttgcagaactgtgaacaataaatttttattgtttataaattacccagtctaagatactttgttatagcagcctgaacataataagacggtgtcaaaagtagactcaatatcattctttaaatgggcatttccctgtgtgttcctaaaaccaggctttctacaacagaggcagtacgtttactcattgagcaccagggtgcttggattcaagttttggcctggccattaggtaggtgcatgaccttggtcaagatgcttcacttgctgtacttcaggttccttatttataaaatgtgggtaataactgtaactgcctcataaagttgttctgtggattaaataaatttatatacttagaacagcgctgtttacagagttatgtgtttaattataattttgactaatgagcctcaagaaatataggaatagaagaaaaaatattaaaatagtcctaaaagaaatactggtgcatttggaagactgaaagagagtatcatcaaagtccataaaaagggaattataagccttataaaactcctttgaagcaaaggataacagaggttgaataactttaagtaggttcaatattgattgattgaatgattgattgtgacagtctcactccatcagaggctggagtgcagtggcgccacctcggctcactgcaacctccgcctcccgggttcaagcgattctcctgcctcagcctcctgagtagagtagccgtgactgcaggcgcgcaaccccacgccgggctaatttttgtatgttttttttagtagagatggggtttcaccacgttgcctaggctggtcttgaactccgccctcctcggcctcccaaagtgctgggattacaggtgtgagcccccccacctggccccaagattaatttagataaattcttagagggtgaatgcatagttggttattgggaaaactgttaacggtctgtgatacataattacttttctgaggtgatggggaaccaaattcttcctacaaatgagaaacagaacttcttgtctacacattaaaatgactttggaaacttagaaaaatatcaatgtcaagatctggcagcagacctttttcaaccaagtgatgaggcccaggcacttgtttttttatttttattttttcctaagggtgccccagggtttagaaacaactaagtcagatatttttagagtaatttgtcttaactctttcatcttgcgtaaaatttccattctgtcatccacaaccggaattccactccgtcataccagtctctcctcgtttttttctgctggctcttttcagcgtgtttcatcgtggctgctgtctgtctgttacagccttctcacgtgggagcccctgccccgccccacgagaaaatacatgtttatcattcagtaagtattgcgcaaaatcgtaacagaataattactcgcgccaattccccccagattagatcagcagaaacacttgggctagaactacctcaggactatctaacaagtggatataccacagtggcgtggagagctgcagtgttatgtgttggccaaatgaagtaaagacaccaagtagctattaggcgaagaacgaagcgtcttcgcggcaagtcggctgtctgctttaaattttctgaatccttaatgttatcagtattatttatttcccccgagaaacaaaatctccaaataccaagaagctgttctgtattgccaaaagctgcataggggcaggctgccaacaggactacccgggcacgctgcagtggcatctctaggcagtttcctttaatctgattttccttgggctaactcctcactgcggtgctgctccacagccagcccccgcgcgcagccctccccgcaccagctcggctgcagagcgcgggtccgccgcccacgccgcctttcaaccgcagtgcgcggcccgggccttagacgcgcgtgcgcgcgagccggggagggcgggccccagccggaggaggcggaacagggcctcgcgatatgcagcccattggctctctcctgcagtccccgcccccgggcgttcgaggcggcggggcgggccacgtcaggcagccggcgctgggctgagcttgtggcagaagggaggtaagccgtgcggggcggcgggctgccaccgctgcacccctgctcgggagccgccgggtcgcgccgcctgcggcccggtcggcttgcatggagggcggctgaggccctgcggggctggggctgagctgggagacggggcagtggagcatgtggcggcagggccgcgtcgcggcgaggggcagccgggagggggctttttgccctcgtccggtcctgctggggctctcagcttctggaggactaggccttctgaggttacggagctccgagatacctgggcagggctggctgtggtgactgcggtgggacttagtgggatctcgactcggaagccggtcggcgcgatccttgcatacttagctgcagcaggttgcagtcgtcccactctccttcgaccggttccctagttgggggcagagcaggagattctggccgcgtcctgcctggcctggggtgactgtctccttctcattcccggtgactcactcagatcatgtccacttataatgcaaaggcttatgggtgagcagggcctgttttcagtctcctagttctctggctccgtccgcacttgcggcaattacttgaagaaagagtatgttagatgtatgttttgaaattttcgcagcagctaacgcgtggagacgtgcagttatgttgcatttacccttcatgagttttagtttcagctgtggcgtcctgatatctcagtgtggttcctgaatttggagcttttgaaatgaatgaaatcctgccaatttcatgcagtcattcattcatacattccaaacttttttgatggatgccttaatggtcagcctcataccaggtattaaaatcggcatttcctgcgttttattccagtttatatgttagttttattgtctagatttgagttggaaattttttttttttttgttattttcaggttctagtatccctgaaaccatcgtggctctgagggtgtaatcctgataactgtatcagtaatgactccaggtttcagtggcctatctgtaagaagaggaatgggattagtataattttgagattttccaggagaggagggtagatggcatgtttcctgaactgtgttaacaggaagtaactattttaaaaacacaggatgcattttatgattatgttttactgtgtcaacgaacattgtatctgtccacattcactttttgactaccaagcaagtgcatgtttacaattttgattcacatccaattcctgcgtagaaagcactgtgactcatctgaattttgaaatgaagtaatcatgagctttttaatgttacatacaaaggtatgatattgaaacaattgcataaaaatgcaattttcaaagcattttcacttgcttttatagattagtggaagctaaaacctctgccttgattatttgcttacttaatcaatgttaggtagttaccatctcttggctaatgtttatcaatattatatctattttaacatttgtttcattaaccccaaatttactggattttaactgattgttgtctccagttgacgcctgataaccaaaaggttatcaggaggagctggaggaggcggaacacagcctcgcgccctgtaataaatagtttgaaatcaaaattttcatggacgtataaccagagtttttcatttgttgattgattgatggtgcttaccggtaaatcgtttggcctttttccccgtttaaaatgatttatgaaacagtctgagacataatattcttagcttcatgatacttttgggatattgtccacaagtgattagttgaattaaattgttaatatcactattaggagtttggaaaatttaagaaaatataacttcttaaaattttgcatttgctatttttttgtttgtttggagacagggtcactctgtcgcccaggctggagtgcagtgctgcgatctcggctcactgcaacctccgcctcccaggttcaagtgattcttctgcctcagcctcctaagtagctgggattacaggcgcatgccaccacacccagctaatttttgtatttttagtagagacggagtttcaccatgttggccaggctggtctcgaaatcctgacctcaagtgatccctccgcgttggtgttacatctttcagttctagaaatggacctgatcaagattgcaaggttaatggggaaaattcaagagctgaggacattaaccttctagcgggaaaaaaccacaatgagaaataataactatatttggaggaagtgtaaggaaataatagtttaaggattattagtctataacaaatcttgatcttaatcagtatttcttgatgtataacaaagaacttggtttaagcacaaaaagaaaattagggtgataatttaaattttgatcaagtgggtagtaagtatttctttaggagatgagaaatctatagatctagagatgcatggtataataaagtatggtatacttatatgagtataagtctgtgattcacaattagtaatagattgatggaggttttgttactatttccacatgataagaaacaagatttgctaagctgataggacaagggatatttgtgaatttcctccatgtaaatgatttgaaacaacaaagttttaagtgatgtggaagagcccatctattttcaaacaatggattgaaatgtagtttttgtaaccctctaagtacttctggcctcatagttttttttttttttccccctactcaggtcatattgaaagtaataaaattgtgtttatgattttaaaagtttatattggctttcatttaattagtctgagttactttagttttatatattttgaagatgttccaaaacccttgactttaaatactgtatagctttccattgttcatgaaagaaaacatttctttaggccaaaggaaattgagaatccaacttgcatagatagtcagtttattactattatttaaagatttatctttttacttgcccggggaccaatgaagcatccactgaagctcctaaactggagaaggtatcttctaatctccttttggtcagatgagttcttgctaatttggctgatacatatgttgaacaaatgtaatacagtaattgtgggtgttgtaactgtagttttatgaagtttttttggttgccagggtgtatctttcccttctctcttgacaaacctttctatttggcctacctgctttcataatttattcttaagttctactctatttcccaatcattgcacatgttggtttatgtaaccaaacctgattttagtatatgctattaggacatacacgtggagaagaatggaggaaactttttattaaatgtttttaattgttgaaacacttaagtaaatgtgatttttaaagactcatagttattaaaggtattgtattcattattttttatttattccttcattcagcaaagacagcaactactttggtgctaggtccttaacttatctttaaggaacttacagtattgcatggacttcataaacaacaccaaaatacaatgggataaacattataattagtcgttcacatagtatagtgggggatagagaaaactgtgtgcaaggtttgaggagattcagagaaggctttatggaggaattttcatctgaattgaagtttgaaagtgagtaggaattagttggtgaggttagaggataaggcattctgggcacaagaaagcagtgaggacaaatagataggttagaaacgggacatagacccttaatgtgttaagatagagaatagatcaactttaaaaagtaaacaagggtaaataatgaaagttctcttccacaccgtgttagccattttgagctttaatctggaggctatgttgatccatgagtaatagattttaagtggaagaaagttaacatcagtttcatgaggcaatgtgaggaatgaattgtagtggggtaaggcagacatttgcattacatgtgacagaactccgaaaatgcagtgctgctggagagaagaggatgaattccagatatattaaggtgattgagttagtggccagatggatgtaggggatgaaggagtgatggagtcaaggatacctcctaggtttatgacttgccgagataggaatcacatgagcaatatcagatgtatggggagaataagatcagtagtcttggacatgggtttaggtcacacaattggtgctgttcagtgggtatttggctgctttggcctggagttaaagagaggattctaggctggagatagagattaggatgctatcaatttataggtagttaaaacaatgtgagaatggatgatgcctaagagagtttgtagaataagaaagaataaagcagaagggaaacgctgggaaacactaccctgtaggaaagatgacccagtgaaaaagacagaaggaacagcctaatgacagtggatgtctagaagataaggagggagagaatccaacaagaagagactggtcagatgccatagggaataggagaaagagctaactacagtttttggaaggtttcccagataggcctggatcattaatttgtaataatactagttcatatgattctgtgacttttggcagcaaaattcagtagaaccagagatgataaatagttggattgatacagtatttggattttgttacgtgcgtatggtaagattgcaaaggagttgaaactattggtgaaagaatggtcagagtgatggaatgtgaagtttagactggatagggatgacgatagagccaggaggagctgaaagattgagataacataattggttcaaaggattaaaagtctggatgaagtaaatatacaagtgtttgtagctaaaagggagataatgaaaaggatagaaatcctctggtcagagtagaatattggaatttaagatttttagggtgcagatggcgtgtagggtttggctgtggatatagatggtagaaacggaggtgttcaggaacaatgagactggtggtgcattcgatgaattgctcacccagatgactgtagatgactgtggtacccagggaggaagggtagaatgtgatcctaatttccgaggtttagattgcctatggtggtgatcactatagatgagagatgaagatacttagatgttatgccctcaaaagtacagcgggtgggggtgggatggggtaagtggtctggaaacattcttctgggccttgggacttggaaggatgattagcctttactggtgggggccaccaaagaaggggagtttaatttctattaggcctaggaggtatggggagcatctagtgaagaggctgaggatataagaaagcttattgactatggtgtcagtgtaaaagcttgggaaggagtgagagagcgagtaaagattatttagaggagaagacaggttagaaagagcttagatttgggtataagggtgacagcgcttctctgaagcatatggctagcttttagtagttgggactttaaattttgatgaagctttctgttgttaacgtttacccatcaagtcattatagtttctgtcagagtaggacagttggcatagtactgtttctaaatttaaaaataacatatatgtctccagtgaatatttgtgttatctgtcggagaaaggatggacagtgtggcctatttgctttgatgtaccttttcctggtctttgaattcccaaaatacttttgcaaatacatttcatcatgtgtgccaattcttatctattggtaggattaggaagttatgttgagtatttttaggtcaattctgggcccagaggtataggaaatgccttaatgtgaatggcaattgccatgaatgtgggagattggcatacctgcatttacctaagattgccatctgttattttctgacctagagtctgtttctaaggacagcgcctcacttatgcactaggtcttattccttttaccttccgaaggatttggctccagcatctctctctctgaacattgcatttcccctaattactggattattccgttcattatgcaagtatgctggtatttttccatgttaaaataatagcttttgaccccattcctgcttaagccactgtacaatttatttgttaccccttatggtataactataatcctgtccaatttctttccttctattctttcttaaacccactttaatcaggctttctccctcacctctatcaaaaaattactcttactaaaagtaacttttctgagaagttacttttctaaaagtgactttatttttcatctagagacagagtcttgctctgtcgccctctctgaagtgcagtggtgtgatcatagctcgccacagccttgaactcctgggctcaagtggtacttctgccttgcctcctgagtagctaggactgcagatatgtgccaccatacctggctaatttttctatttcttgtagcggtgggggtcttaccatgttgctcaggctgttttgaacttctggcctcaagcaatcctcctgcctgggcccagagtgctgggattataggcggaggcaccatgcctggccctttcattttcctaaatctaaaggtctgttccaaatttttacctctcagttgacctgtcagcattttttttttttttgagacagctagtcactctctgcttctttatttttatttttgagacagagtctcactctgtcgaccaggctggagtgcagtggcgtgacctcggctcactgcaaccttcatctcttgggttcaagtgatacttctgccttagtctcctgagtagctgggattaccggcatgtgccaccacacccagctaatttttgtatttttagtagagatggggtttcaccacgttggccagactggtcttgaactcctgacctcaagtgatccacctgccttggcctcccaaagtgctgggattacaggtgtgagccatagtgctggcccaatctctgcttcttaaagcactttcttcccttattagcaaaaataccacaattcctggttttcctcctacgtcattgtccctttttagactcctttactggttcttccttatctccctgataagagtgctgttaacattggagtgcttcaggggtcagtcattagaccttatacttctggatcatatcattcagcctttaaatattagcattattattatttattaattaattaattttattttattattattttttgagatggagtctcgctctgtcccccaggctagagtgcagtggcgtcatctcggctcactgcaagccgcacctcccgggttcacgccattctcctgcctcagcctcctgagtagctgggactacaggtgcccgccaccatgcccagataattttttgtatttttagtagagacgggtttcaccatgttagccaggatggtctcgatttcctaacctcgtgatctgcccacttcggcctcccaaagtgctgggattataggcatgagccaccaagcccggccaatttattttttgagatggagtctccctctgtcacccaggctggagtgcactggcacgatctcggctcactgcaacctccgcctcccgggttcaagcgattctcctgcttcagcctcttgagtagccgggactacaggtgcgcactaccacaccaggctaatttttttatttttagtagagacgttggccaggctgatctcgaaaaatgatccacccgccttggcctcccaaagtgctgggattacaggtgtgagccacggcacctggcctaagtattagctttaaatactagtaataccctactagcttccaaatttatattttcagcctcgccttcccttgaactcctgactccgtatatccagtgactactcagcattttctgtttggatgactaatatatatttcaaactaaactctgaaatttccttttttacctataatctttcctatttcagttaacagaaactccatcctttttatgagataggctaaaaacctgagtatcatccttgactcttctttatctcacaatctatatatatatactgttactttggaaagtgtgttggctataccttcacaatgtatttagaatccaagtacttgtcactacccactgctatcaccctagtctaagcccccgttgtttatgtccggatcttgcagtagcctctatattagttatcaattgttacctactcccaacattttgtggcttaaaccaacagttatgtattagtttgtgattctgtggttggcagcttaggttggacttggggtagatgtggggcagctcttttgctggtcttgcccgtgctcactcatgtagtgatcggcactggtaggtttggaggcctcagctgagatggcttatctctgctctacgtggtcagtaaactatctcatgtttatgtttctttacgtagtggtgtaatggaagcaagataacaagaggaaactatgtggccttttgaggccgggacttagaacttctacagcttcactttccctgctgttggtgagagcaggtcaccaggtcaagccagatgaaggggagagaaaattagcctacttttttttctgagggggtgcagcaaagtcactttgtaaagcagtttgtatacagagattgggagcaattggaggccattttttgcaaactgtcctggccttctaatggattgcttctatctttccccttacagtattgtcagaacagcagccagagtgattttataaaaacgtgagttagatctcttctctgccccaaactctccagtggcttcccgttgccacccaaagtaaaaggcagtcttgggattgtcctgtgaggcttgccatgatctgacccatttgttgcctctccaactccatttacagccactctctctctcttacttaatctgctcaaatgagcctctgctgttcttcagacatctgaggcatgctttcaccatggcattggcactgctactctttccgcctagagtcttcttttctgagatgacgaaactgctcttttactccccttcaggctactcgagtacttcctcagcctttccctgaccatccttttaaaaatagaaacctctctctctaatactgtctatcctccactctggtttacttttatccatagcacttatcttcagaaatgctatgtaatttactattttgcttattcttgtcttgcctctactaggaatgtaatctataagggcagggatttttctctgttttcccagtgcttagtatagtgtctgatacaaggtaggcatctcataaatatttcttaaatggaggaatgaaaggtactgcaacctttttcaggattaggtatctcttccattctttatggaaaagctctggaccattatctgaggaaattcctggtctcctttgcaagtacttttgcaatcactatttatttatttatttatttatttagatggaatcttgctctgttgcccaggctgaagtgcagtggcacaatcttggctcactgcaacctctgcctcctgggttcaagtgattctcgtgcctcagcctcccaagtagatgggattacaggtgcgtgcttccacgcctggttaatttctgtatttttagtacagatggcacttcaccatgttggccaggccagtctcgaactcttgacttcaagtgatcttcctgccttggcctctcaaagtgctgggattgcaggtgtgagccaccgtgcccagctgcaatccattttttaaaagaggtcttctagaccaagtattcttccacatccagactctaatttattctttgcaagaagattatcatgttctcttaactatatgcaatacctttcttgatacttaatagcaacctcttcactttgagttgtaaatcataacattttttgtacaaagcaaagctgaaacaggtgaaaggaatagtctagggcagaaaattttcaaaccttttctaaggtcttagactctctccacctccacatatcttactgagaacttcagataagagaagtgttttattattcaaaataaaggttttattattcaaaataaagctattttacatttgaatttatagcatactcttattataaagtcaatctgaaccatgaagctattataaggagtgtaatattgaaatgaatgattatgaataaaaatgatactctctatatgtctcagcctccaatttatttttgtattgtgattttgtattttggttttgttgcagaccatcaaggaaatttccatccacacagattagcagttgaaaatggtaataattttttttaacagttcacattgcaatcttgcaatctctagttacttttttaaaattttcttttatttttaaaaatgtcttactaaaacatacacagattaatagggaatatagtaaatgaacttaatttcaacaacatcaacattttgtcaatcttgtttttctctctaacattttttcttccctagtaattgtctttaattaataaggacttcttaaagtactattactaggccattcattaacaaccctaacaaaattaataccaattcctaaatattatccaatacagtccatatttcagaatttctcagttgggccaagattgtcttagtagaattggttttttgaaatcagaatcatgtaagtttcccaaatataatataatttggttactatgtctgtttagtcacttattctgtacaatccctccactccttttttcccatgtcattgatttgttggagaaaccgagtactttgtcctgtaaagtgtcccagattctggacttgatctattgctctgcaagtggtattgtcctggaagaggtaccttgttcctgtatctcatatatttcttgtaaattggtaattaaatatagagagttgtgtatattagtggcaaatttttttttaggtaagagtatttttacagaagcctgtgtatgtcctattccatcacccatgaggatacaatgtgtggtattcttacttttagtgatgctaagatgaatcaatggattcaagtgggatcatcctgatccctctaatataaagttccctatcttcctttaacttaatatttttagccacagttgatgattcattcacaaatcaaagtatttattaacaaagtaacttcatattggtaaagatttttcttaagcccgtaaacatgctttcattttttctttcctcacgtttctttttacaatacaatcagttttttccctgtcccctcatcctacatttatacacgtacacagtcttcagtacatgttgaacatttgacataaagcttgtaaagagatatgaaatggaatggacaacaaaggaaggcgaggtagggaagtaaggattatccacccatctacctactaacttacctgtctcctctccttctctgtatcttactggtttcagtttataatattttaaaagctatgtgggataagtatggcttagagggctactgaggccttacagggattggaaattggataggacctgggcaggtgttgactgcagcattggtattaggtatgaattgaatataaatccaatctgcagctaagcacacacattttaacatttgttgtgtatagtcaagattggccccaaataaaattgagaagcaaatgaagcttatacagtctgcatgtggcatccttttatcatatagctttttttagctgatatggacaaaagtaaattgagcttccaagaatttaggagactcatgcattgctgcattgttttagaaatggataaatgatttcgacttctgcatcttagtgtatgactgctttgttctttcagttatctgaaccccaaactttggagtcatccttcactcttcccacatttcatgtctaatccattagcaaatcttaccaaatatttctgaaatacttgtaactgcaggcatgtatcctttgaccaaatggagacctaatgtatatataacatggtgactatacttaatgataatgtattgtatagttgaaatttactaagagagtagatttcaagtgttctcaccatacagacacacacacacacaatggtaacaagatgaggtgatatgtttgattgtggaaatcatttcacactgtatacatatatcaaaacatctgattttgtaccctaaatatatacagtttttatttgtcaattgctatggtttgaatgcttgtccctctcaaaattcatgtttaaatttaattgccattggccaggtgctgtggttcatgcctgtaatcccagcactttgggaggccgagacaggtggatggcttgagcccaggagtttgagaccagcctgggcaacatggcaaaacctcctctctactagaaaatacaaaaattagctgggcatggtggcgcaagcctgtacttccagctactttggaggctgaggtgagaagattgcttgtgcccaggagatgtaggttgtagtgaattgagatcatgccactgcactccagcctgggtgacagcaagactctatcttataataataataataataataataattaattgccatcgtaaccgtattaagaggtggaattgttaagaggtgattgtcatgagggtgctaccctcaagggtgagattggtgccaatgtaaaagtcggtcctctcctgccctctgtctctttgcacttccaccatgtgatgatgtggcacaaagaccctccacggatgttgacaccttgatattagacttcctggcttccagaactgtgagccaataggtttctgttctttataaaatattcccaatctcagatattctgtttagcagccaaaaacagactaagacatcaattatacctcaataaatctggaaaaaaataaacatgtcctaagtctgacctcttcccactatctctactgctgttatccttgtccaaagcaatatgatttatctcctggattattgatgtaacctaactggtccgtctctttttctttttttctatccttgccctcttatggtctctattcttcctagaagccacaatgatctttttaaaatgtcagtcatatatgccattcctctttcccaaaccctgtaggacttcccatctcactgagaaacatccaaagactcccagcaccctgtagaggcttacatgatctgggtttctgcttcattctgtaatctctcactgcctaacttgctgacttgcactagccaacactggtgtccttggtctttcctaaacttgccaaacatgcttccatctcaaggttattccttctgtttggactgcacattacttccttcaggtgtctgttcaaatgtcactatcagaaagagctttttttattcttcggcagatgccaaaacgtttaaagacctctctaaaatttacctattgatgactaaaattttgattttcttggtattatgttgtgtttgaatttggaaaattaaaaactacttatactgtagttcaagcaattaaaaatgccctctagactgaagctaacatacttgattaaaatgagactggaggatgttgaacacagtggaggaacacttgatgtttttctcaggtgcagatggattaatctcctggcaaacaatttagaatcaaaggtaattctgttagcttacttgtttggaactctgcaggaccattatagcttctaataactcaaaggtgtgactttcgcattaaatagttcttaataagtggtataattggatcaagtgagactttttttgccttggcgtgtgctgtggtgaaaccacctctttagagaatgataaaaaaccatggtttcaagtgaataaataagatcactttttttaaaattgcaattaaacattttatttttttatttgaggagaattaatttctttgtaatttaaaataagtaatgtatgccccattgtaagaacaaaattaaaagtagcaaaggcggaatacagtaggttacataatcatccatcatcctgttcagaaataaccctatcaacatttttgcctatttgtttttttaattctatatttctctctatattactcacatgcacacattatatatactatatgtgtatacacacacacacgcacacacacacacatatatgtgtatttatttttatttttgagatagagtcttgctctatgacccaggctggagtgtagtgctgcaatctttggctcactgcagtctcgacctcctgggctcaaacagtcctcccacctcagcctcctgagtaactgagaccacagggacacgccactgtgcctggctaattttttattttttgtagagatgaggtctcactatgttgcccaggctggacttgaaatcagcctcccaaagtgttgggattacaggtgtgagccactgcgcccggcttatgttttaaactttgttgtgttcatggttgtatgcaaaaatttctcaagtgttttttattgtaaacttttctttacattattaaaactctttacaaatgttattttcaattactgatcaatattttatctgcatagtccttagtttatcttttagatttgtccattaatacttttgcaaaaagtgtgcttgattttaaacctttttaattcttaactcacttttaaaatgggagctgaatagaacttgaaggatgtatgccacactttgggatatagccaagaagtgtcagatagtaagatcaaatgctcaggaagtggtacccagactgcccaccacagaatgatttagtttttggcttacctcagactttcagcttcatggtgctaaagttccctatgaaattaggtatggtaggtgggacttggggagacttttgtggttctgggaatcatactggttctaccttatttgtgtggcttgttcctgagctgatctgatctttgataacctttctatcagtttggaagtaagccagattgggagcaatttcttagatagtgtttgaatttgggctgaaaggcagaagtagtctttgagggtgaaatgaaactcttttgaagattggctttattgtaagttgctggtctttggagtggctgttgctgttcatctagttggtcatttacttaaaacagagtgttgaaaagttcccttaggcctgtatgtatgaaaatcatatatactagttttaacatttgtgaaattaaaaaaatcatgaagagcacctgggcgcagtagctcatgcctgtaatcccagcactttgggaggcccaggtgggtggatcaggaggttgggagattgagaccatcctggctaacacagtgaaaccctgtctctactaaaaatacagatacactgggcatggtggcgggcgcctgtagtcccagctactcaggaggctgaggcaggagaatggcatgaacccaggaggcggagcttgcagtgagccgagatcgtgccactgctctccaccctgggctacagagcaagactccgtctcaaaaaaaaaaaaaaaaaaaaaaaaaaaaaaaaaaaaatatatatatatatatatatatatatatatatatatatatatgaagagctacatattacatcttaaccccttcttcgttctcctcctcctccatgtttgtttaaataaaattcttaaactaactttatctgaaagacatcctacatactgtactctgtcaattggatgtcagcatttcaccccaagatcctcttctgattcttgaatatgctgcttgatatttccacgctaatatgaaatgatttactaatgaactcctgcccaggatgattgcaaacgttaactaatatctgattatttagtaccctataagtaaaaacagccatgagtaatgctagctgtataatagaagattagtaaatgttccttttttttttaaagaaattatttaaaattccttttaccccaatgggaaatacacagaggtgatactgtgggtttttaaaggattgtaataaatagcagattaagcacatagctatgataaataatagctgtcaatggaagcattcatgtaaaacttatgttgtattaaagtaacaaagacccattttccatctctattagattcagctggaaacagtgaagaaacagtcttgttagcttttacatgtgttctttgatttttttttttaaagaaaatgtaccaaaatttatgacagcataatgaaattttactggtgtagattctgctgattttggatttgaatttggctgaagttcacctttgcactatctacacaaaaatgattcgcctagttaaaaaaaaaaaaaactgggagtttaggatgtgtctaaaaagaattatcatcaattcctaaatgtgttggttactaaattcaagttactgtattaatttggacataaagttgtttaaacatttatttttctacttctggctgttatttattttggtctttgtttcatgagtcttaattaatgaaaaagatatagattcctctctatttcttagtttctgttttggaaagtttatctgaaaacaaaataaacagtggaatcctgattctaacatttttgagactgttaggtactgtgctaaacacaataattcagcaaacatttattaactgcttattccatgccagaccctgaagggggtgaacaagaagctgcttctcttaagaaatccaaatgtccagggtaataatgcagcaggcttggtcagtggggacccttcccacttctgattcttctttactggcatctgagcaggtgcagctgctatatagatggaaactaggcccttcagaatgagacaagaatgtcttgaggagtgattataaccctctcagagctggaagggacattagagactgatcttagctctccactttgtcctctcaaaccatatcctcatattccctctgcctggaatgtgatgccaagttttagttcaagccctgttttctgaggcagctgcaggaactgagaaagaacatgcattggcttccttttgatcttcctgcttctggacatttcttcctgagcgttccaatattatttcaagccctgtttttacaagtgaactcatgcacacacaaatttccctgtctcattgagctgtgttttcacctgtcacatggtgaggtttcctgccagctaagtactcatttgcagtggcattgccatctgtgtgtgtgtagtgtttaagcaatcatttgggtatataattgctttaattaattttagtgattatttacttatttaaaaaaacagaaaatgtagatgtgaaagtgttgatatcagtgacaagaagtatagatttactacagattgacaattgtcgtgatggaagtggccaattgttatcctttgttacctactcattgaacttaaactgaacagtcaatgatgaaataaaggcatataaccaaagaacatatacagatgtgggagatgtattgctggtgatggtgccacaaggatgaaagttaagtttagataaacaatttttatgttttgtgctctgggcaaggagtaatcctttaatatgtaatgtttgcgcattagacttgattacctttttaggattgcagtatatacaaagatacaaagctgtttgcatatgctgataagctgctttgggaatttgatttaacacgtatgtgcaaacccaggtaattcatttaaagatttatttgatttcctgagatgcagcaaaatataatggaaaaaacaaggtattagattcagactcagaataataacatttaaaaaccgtttgctatgttcatggctctgagcaaaatgctttaatggattatcttaatttagctttagttttttaactttattattgttattgttattattattattattattagctatagggcattgttctgttgcccaggctggagtgcagtggcatgataatagctcactgtagccttaatctccagtgctcaaatggtcctcccactgcagcctcctgggtagctaggactaaaggcatgtaccaccatgcccagctaatttttaaaattttttgtagagatggggtatcactatgttgcctaggttgatttcgaacccctggcctctagtgatcctcccgcctcagcctcccaaagtgctgggattacaggcatgagccaccggctgcttgatgatcttagttttacaaaaactttaagtcaactgtatctatactttattaaagagtggttaagcatgtgagatctggaggcagactgtttatattcatgcttttgcttcttacataattaggcaattaattttgacctctcctttcctcacttggtttttcatatgaagataaagttaatagtagtacttatgtcatgaggttgttttgaatatcgagtgagagaatacgtataaaaagctttgacagtacctgcctggcacatggtaaaattctcaataaatcctggctgttaataccactgtataacctcaggcaagtgacttcttccctgagctcctatttcctcctgtgggaaatggagttaatatttacctcaaagttgttgtgaggatctcgtggaattagttaaagtgtcttgtggagtgcttagcacataggagatgtttaatccaatatggtattccaaattctatgttatgctttgcatttattcagttaatctttattgaataggtatttgttatatgctggggagatagtggtaagagctgagatcgtgccactgcattccagcctgggcaactgagcaagactccatctcacaaaaaaaacaaaacaaaacggtccctgccttaaagagtttgcatttggggaggtgggggtggagtagggaagcagaaataagtaaatgacaatcatttgagattgtgataaaagctatgaatggtacaatagtgggtcactgcagtggcaagtaggggactatttgaggctatgggggtggtggggggatagggaaggttcgagggaacatgtgaagggagagaagaaacagcttatttgaacaattgaacaagtcaagagcacttgaggctgaggggcctgagagttctagacccagatgtcgaaggagctgagggtgtggttgtcggggtggtttaaggaagaaactgaaggccaatgtggctgaagtgccctgactgaaggagagttgcaagaccagaaccttttggccttcctatagagttgcagtggggagccattgaaaagttttcagcatatgagttaaaagtcaactgtattttattccatgtctttgctattgtgaatagtgctgcattaactatattttaaatgggaatcttatgtatattctaaccttggggctggtgtcttatttctctctagtgacttgcatacaagatcccatctttgcatataagtaatttatcttttatcattaaaacaatttttctacttcattactgctcacttgatgagagattccttatcacttaaattcaaattcttttccatcattcaccttccttgactgtcccacatggtattgagggagggaggaagcacacatttctacagtgcctgctatgtgcaagactctcttggctttaaggcgtactttatattgttatgcacaagaccttgtttaaccaatgaggaaacaggttccaagatggtaagtgatttgcctagtgctggaatcaggatttgcatccaggtctatggttccctcctccctttagcccccaaagggggctccccaaagcacctcagagctttgctgtctgtgtcaggttgctctgttatcatgatgatagaggtaggtaagactgtgagcttaatcagattaaggtgttattcttctctgtggacaatcttagagtttgcaaaagcatatatgtcattgcttcacagtgcaccattgatcttattcatttgaacattttcactgtggttcttctaacagtactgcgataactttgtttttgtccttgtaaccattaaggactcaaatacagagatactctccatgtccattttcgtgtatgcacattgactttgttgaaaatagagaaatttactatcttgttgtaaaatttttttgttcatttggtcttcagctttcattagcactcagtatgcaaattaaaatagctaaaccatatctattccattctacatgaatttagtaatttagtttttatgaaaaataccaaatgagcttgattggtcactttgcaacaatcaaaaatgttgccaataaacttgtaatcagtctatatagttcttttccagagtaagaattttattttggaggaagatttcctagcagtctacttggggaaattataatagttatttttctccttgaaaatgaaggaagaaagcttttaagtggtttaaacttaatctatctggctgaattacattggccccttttcaatattactcttttcataaagcgttggtaaacataagtaacaaagtaatctttcatcattttatcaacaatttttctactaaattgctgctcactttatgacaccctttagtgatggatttctacgctttcagtgatttgggtgtcagaaagttatatcctctatttctacaaaatgtattataatgttagtcaagattttcctattttggtaactttattaaaattacaaaacacatattctcatagaacaattagaaactgggaatgagcaaaaataaaaattatccacaattggtacattccgggcttttctttgtgcatatatactctggagcgagactacttaggttggaattccagttctgtcacttactctgtgaccttgggaaagttatctaaattttctttgcctcagtgtcttaatctgtaaaatgagtaactatctccgggttactgtgggggttgaatgagttaatacatgtaaaatgcttagaatattgcctttcccctagtaagagccacatacatgggttttaaaagaccttttattatggagaatttcaaacataaaaatagagactagtattatgaattccagtgtacctattattaacatttagacattcctgtttcatctatcagtcttcttttatttttctttcaatacttgggtattttatagaaaatcccaaatattacatccttacactgtgtatactttgtaccatattaatatctgctaagaattaggtaggttattttagagagtgagtattcaaaatttgagtcatttttaaggggagaaaatacaagcaaaatatctaaagtatccattctgtgatgttttactaatttagttaactgaatggtatttgaagtaagattgtgaatgtggagattttgcgatcatttattggccaataacacatttaaaataattaggtatcagttttattttaaatatactgtaaatattttatatgaacatgaagtctttatttagaaaatgttttgtactgggcaatatatgtaattgttttggtgaaggaaaaatacttaaaaattataatattggaaaaaaaaaagtcaactttgaagatttagattggatgctgaaaaaattctagagattcataagcccttagattttaaaaaataactatttttcattgatatactcatatatttagcatatacatatccatatgccacaagttaaaacacagaataattagagaaaatttgtaactagttaggcattattcagttttaagtttttttttttttttttttttttttttttaaacagtggctggttctgtcacccaggctggaatacagtggcacaatcctggctctctggagccttgatctactggactcaagtgatcttcccacctcagcctcccaagtagctgtttctacgggcatgagccaccatacccggctaatttttaaactttttgtagagatggagtctccttatgttgcccaggctggtctcaaactcttgggctcaagtgatcctcttgtcttgacctcccaaagtcttgggattacaggtatgagccaccgtgcctggccaagtttgtagttttattttttattttaatgcctgttttcctggacagcaatcagttctgacttggaatttcctgcctttgatcttattttaggctcccatttcaaaatctgtaagtagcatgtgatattgagaaggaactaaattgtaaaggcaggaatttgatagaattcattgtacttttattaaatggcagccagtgagatcatctgaactcatagtcatgtaaattttctcagtacttgaattattgatcttaaaattcctggatacgatgcagtgatatggaattgtgcaggtcatgcctcatgttaccgatggtccagtggaaagaacacttggttggaagtcaagaaacctctgttctcacttgaactctgtcatgatgactttcctttttggcaagttgctttaacctctctgacattgtttcttcatttctctagtgaaaatatgtagggagggagatgatgttaggtccattatattagttaaggaagtgctagatattgcaacaaggagaccccaaaatgaaatggttcaaacagtgtagaagtttttcctgtaatagttggagttccaggtatgtagccgtgcagcaagctatcatttagggatccacgttcttcccattttgtttcttcaacagagtcccagggccattgtcttcatgtgcgtggttgtgtctaggctgttgcccagaattcactctggttccgaagagagagtggaggaagcagaccccagcctggaaatggcatgtcacttttgctcaaacaccactggagagaacttgatcacatattcttactgtaccatatttgaggctgggaaatgtaatgaagttgttcaggttacagttttgttaatacaaaagaagagaacagatattggtggataaatagcagtctcttccacatcatatggttgctgctttctctgattataatattgaccaagtggctctgtcacaccactgagttgctatctacttcagcttgattttgaaattattggctaagataaaagtattttctactctgggtttaattttaatgtgtcttaatggtctctctgagaatataataactaaaaattactgttttcttacacctgctctttattgttgaaaactttcaatttttatgaatttttatgaatcatatacagttgacccttgaacaatttggggtcttggggtgccaatccctcatgcagtcagaaacctgtatgtaactttttactccccaagaacttaactaccaatagtcttatggatattataaacagttgattcgtacacattttatgtattatatatactgtgttcttacaacaaagaaagctagagaaaagaaattaagaaaatcataaagaagagaacttttcattaagtggaagtggatcgtcataaaggtcttcatcttcaccttcgtgttgagtagggtgaggaggaggaagaaaaggggaggttggtcttgctgtctcaggggtgccagaggtagaagaaaagccacgtataagtggaccttttctcaagggtcaactgtggttaaaagggttccaattatcttgtcctgttattttgggagtgttggtggcagttggattttttaagcctttgaagcaagagctgaggctaagtgtgagcaggtgtcaggatttcatacaaggtgatgaaacaatcgagctgcctgatcttagagagggtacatggaaatacttagggactgggaagcagtagatgagaagctaagcagcagaagaatgagaaagagatccatattagacagtacaacaaggtgggcatttgaaaagtataggcagaattttccccctcttttttgagggacagggtcagtcagttggtgactctagaatccacccttgagccatagtcttgataaatttataaaatcagctcaaaatttattgatagtgcccatcagcttttctataagccatccacaacaagtaagaaaaaagataaaaattgtcaaaatatttgtttaaaagtatggttttaggctgatggttccatagcttaatttgtgggaggaagaaactaagtaaattccataactgataattggaatagttaataaaatgttagaaaaagaaaagtcctggattttgtgtctctaaaacatagagcccattaatgtgaatgaagtacttatttttttatcagccattttatcagtgtgctgatgatactgctcctgtaaactagctttaagaatgtactctgggctggatgtggtggctcacacctgtagtaatcccagtgctttgggaggctgagggtgggaggatcacttgagcccaggagtttgagaccagcccgaggaacagagggagtccccgttgctacaaaaaattttaaaaaaactttagccaggcacggtggtgcatgcctgtagtcccagctacttggaaggctgaggatgggcggatcacttgagccctggagtttgaggctgcagtgacctatgattgtgtcactgtactccagcttgagtgacagagtgagagaccctgtctcttaaggaaaaaaaaaaaaattctgtttagccctgagtttcagccatatgactgcccttgagccgttcctatatagaaatttggtagtcaagagtgctcaaagtcaaatgtctgtcttcgtcatcattggaccctcctcctccaactaccttgtatatcagttattgtctctgctgggttttcataattgttagatttcctcttgcttttaagattgtgtcctttatttgaggtttgacattaagtacttttgtgtgatacatagttgtacaatatcctagagaaactattgagaaagttgaaaacccaaagtgttttatctactgctcttttattagtgcaattgatagattaattttcttggaagtattcttaggggctgaactaccttggcagataatgtgataattgcttatattaaacaactgttttgattcactgggaacttaaagacttcattaaaaattctctttctgatttaggtttagacagacaaaaaaggcatattgaaaggttggagataaatctttgaaaatcaaacatgcatttttgtagcatgtggtttatggattatattgttactggtttccttttagtaaaatggcatgacaagaagtaatatataaattgtttttccttaatgtataaaatacccaaaggaaattgagtttgaaaataacgtagactgctctccagactgggtgacaaagtgaaaccgtctctgtctcttaaaaaaaaaaaaaaaaaaaaaagtaggacacgtactacacttgccaatgctaaagtgaccatgtgtactgttttttgaaattccctaagaggatatgatgttttatacctagaaaaggccaatgtttgtgattaaccttgaaatataagtcttcagcaaatgaaagacacttgcaatttgtagcccagtgatagcaaatcaagaatgatgtaaagtcatattgcagcttgggtagtggttttgagaatgcttaatggccatttgttaggaaaggtaaagttactatagatttaaaaaacatattcattctctgaggtgtcacactgaaattagggctgtcttttgtaatctttggtatttgtcatctgtacttaggtaatttagataaaaacaacactgtttttccacagtggcccacctcctgaaaacaaggtcatctttttggatggctcagcttcttcacttctataataagctattagcctacccagctgctcacctggtccccaaagacatactggaattacagcattctgggcctggatcagagtgcatagccccacatcttcttctgtatagttctatcaccattgatatttgagtaattatattctgtgacatatcaataatcttacctgcttctgtggatactgtaaagtcagccttctgttgagttagattagatcatcagaaaactctgtacttggatcccagtagctgagatttttttttttttttttttttttgctgaataacatgttacattttgcctgtggctttatccagggtttgcttaaaaagtaatattactgggcacggtggctcacacctgtaatcgcagcactttgggaggccgagatgggcagatcacctgaggtcaggattttgagaccagcctcgccaacatggtgaaacccctcctctactaaaaatacaaaaaattagccaggcgtggtggcgggcacctgtaatcccagctactctggaggctgaggcaggagaattgcttgaacccagaggtggaggctgcagtgagctggtatcacgccatttcactctagcctgggcaacaaaagcgtaactctgtctcaaaaaaaaaaaataataatataacatttccttttgcttttgttattgagaatattgcatattatatcactctatattccatttataaagcccaatgtaagaaatttccttcagagtttaaggtcacaaaaatgtttgttttctttgataaaggatattttcttaccttttagattataaaagaggtatcatttattttgtttatttaccctagctgcctgggagcacagggccaaatttgaatgttaattgtaggaattatgtcaagaaattttgtaaattaatttaaaaatagttttatgtactgggagttagcaaactatgggccacccacttctttttgtaaataaagtttgatcagaacacagctatagtcatttatttatgtattgcctattgctttcatgctacaatggcagacttgagtagttgctctctggccctttacagaaaaaagatttctagtcctgatacaaatagttacatgtgcctcagaccaaaatgcagtaacactgaatataaagcaatatgattactgttagatgtagctagttggaagaggcttaacagagatgtgctatgaaaggagtttaatatttaagcagtggaagcatataggagacattttatgtgggagagaagaaatgaaatcctgtaggattgagcagattttgaacatgtgggaccattttggaaactgttttagctagattagaattacagcagtgaaaatgaagttgaatgggtaagactgttgataggaaggcataaaagctaggcatcaggatttgcatttaatccaacaaacaattgaaaacccgctatgaaaatttcacagggaaatgatatgatgggaacagcatttcagtacagctaatctgacagcagtgtactaactcagcatggagagccccaagactaagcagttactggagtaagcctgccatgaggaactaagatgatgagtgtagaatgaagaggaatagtaacctctgaggtgctggaaagaaggaagccgattttgtggctgactggatttagagagtggtggtgaacgaaattgtgagaggataactggggtaaaatgaactgaagtgacagttttttgaaaggaaatatgtgttttgtttttgatgtccctaatttctggtgttttagagcctcctaagagaaagtatggaagcgtttggagatctgtgccagatgacgactgatagctgtgggagagtttgtatggagggacaacagcacaaggcagagtggctggggagtgcctccaggagggaagatagcactcgaggagcagagtggacagaggaacaggaggagtcagtaaaacagtgtttcccagtgtgtatcccaggacagactgatagtatagatggttagcaggtatttccattgttgcatggccagatagatttgataaattctgggttaagcaaagttaaatagacttcttgtattagaccctcttatgttctttaataatatgcaacattatttatatctccactacgatctctccctccaagtttagattcctgtattcgactttctacgagacatttccccttgggatacctgtgaggcatctaaaacttaactgtccaaaatggaattctttgtcttcctcacaaaacttggttccccatgtcaggtgatggcagctctatcttttctttttagtaaaaaaacgccgtggtaagaagtaacatagaaattatattgttccatgtgtaaaatggccaaaggaattgagataaaaaataaagttgctcaagctgggcatggtggctcacgcctgtaatcctagcactttgggaggccgaggcgggcggatcacttgaggtcaggagttcgagactagcctggccaacatggtgaaacctgtctctactaaaaatacaaaaattagctgagcccagtggtggtgggtgcctgtaatcccagctactcgggaggctgaggcaggagaattgcttgaacctgggaggcggaggttagtgagctgagatcgcaccactgcactccagcctgggtgacagagtgagactctgtctcacaaaaaagaaaaaaaaagttgctcagattaaaaaccttggagtcatccttgactcctttctcctatattcttttttttttttttttttttttgacagaatctcactcagtcacccagcctggagtgcagtggcacaacctcggcttattgcaacctccacctcccgggttcaagtgattctcctatcccagcctcctgagtaactgggattataggtgcacaccaccacatctggctaatttttgtatttttagtagagacagggtttcgccatgttggccaggctagtctcgaactcctgacttcaggtgatctgcctgcctcagcctcccaaagtgctgggattacaggtgtgagctaccatgcctggccctttcttctgtgctcttatccaatccattagcagccacattggctttcccttcaaatatatccagaatgtgaccacttggtaccccaagtgattctattgaaatcctactgcctctttgtgcagtagctttccatttcactcaggataagtgtgtcagtccctgtagtggcctacaaggccttttatgacctggcttctcattgatcctttgacctgatttaccattcttttcctccttcactctgctgtatgcacatctctttattcttcctaagacagggcttaagcaatttattagcttagggctttttcctgtgcctgtgacactcttccgcctagatatctgtttggctaatctaacttcctttcctcctttaagtctgttcacatgccaccctctctagaagagactgacctggactaccatatttaaaatggaaagtgtgcacttctcccatttctcatctcctttattctgcttcacttttttttaattagcacttaccatcttctaacatattttatgtattatttgtttaaaaaattatctgctgctttctactagactgtaagctccataaatgcagagattttttgcctattttgttcactgatataactcaagcacctagaactgtgctggacacacaataggcaactaataagtatttgttaaatgagtgaatgaatttcaagataggaatatatgtccgcatagaatctttctttcacccatggagatatttttttcctgtgtttcccagggacacactttaggagactctgttgtgagtattatggaattcaaaggaggagaaaactacaagaaagttgtgattgacacaattgggaagttaaaaatttttgacctgcttaagctaataaagtagatttagataggaaaatagtttgcaatcttagaacaagttgttttagtgttgtggaatgtcaaattcggggaggaaagttggacatagatgtcgaagaaaaataccaggataaattacccattcagggagtttagctttggataaaagggtggaaagtacagattgagtattctttatctgaaatgctcgggaccagaagtgttttggatttggatttaaaaaaaaaatttttttttggactatttgcatatactttaaaccggttgaaaatccaatctgaaaatccaaagtgctccaatgagcatttcctttgagtgtcacgtcagtgctcaaaaagtttcagattttgtaacattttgaattttgtattttcagattagggttgctcaacctgcagttagaaaaggctgctagttcattacaatatgctttgttttttgagatcaagggaacttggtttttctgcttgttataagttaatctagggctgtttattgacataaattttaattttaattatattgtaaaagtaggtgacctagagggccctgtttttcaaaataatgtaattggtaggttcagtgcttcatggaaatgggataaattgggatccttaggaaatcctcttattagttccatggtcctgctttaccacctgccttccccatccttttgcatgcttgcctgcctgcctgcctgcctgcctgcctgccttccttccttccttccttccttccttccttccttccttccttccttccttccttccttccttcctctctctttctctctttcacttttcttttcttgtgagcccagtaggaatgataagtgagatataaatattaaaagttggtgctaattgtttgcttgttcctcctttaggaaacagtctgttttaatgtgtgaacttctaggtcttttctatacttcttgaaaaaagttcacctaggcttcacacttgtcactagcagttggattagtgcttagatgaaagcttgtgccaaagtgaggcatagatgaagtaattttatgaccgtttgactctttctcccttataagttttgatccacaaaagaattaatttctatttcaaatgtgtggttgaacttttggatgtttttttcatttccgtagtgcaaattcatctttttcaggattagctctcatgggaaaaaccaagagctgttgggcatttttagtttatttatcaatcatgacatttgagtgctggatgacaatgaagttttgccaaggattactctgcagagccctgtgctttatttccattgttatctttggaatggattacattcacattatttgaggaataattaattggagccccaattcagaccagttggaagactaacaaatattcttttgttttggttacagaagctgcacacatacatgtaagagaagcaaaaatgtcagatgatatcaggaaaaggtttgaatttccaaattctcttatccaatcacaggtaattttgtttgtttatttttgctcatggtaacaaataaacctgttctgtggatttttaactgaactttatatatttaatattaaatattttattctacatgtagagatttatattttgtgaaacaactttaaatatacatttaatttgaaaatatatatttgacatggaaagcaaatatttgaaattgatcaatctcagcttctgtttatatatcatacttttcttcctagagataataaaaccttgattaactagtaggcccctgaatatgtttgtttggttttttttggcctatgattattgggaacagaggtaaacagttatatgtctgaagagtatgagggattaatatttaagaagacatatcctaccccttatatagatttttataataatgatatttaataagtaaaatatcctggattagaaaatttgatatatctactaagatagaagattgtgataactttaaagagcttttcaataattaaatagttaaaacaaagatggctttctgggtagcctttagctaactagaaacattctggttaatcaaggtatcataatagcttattgtcttttcttgtgagagtaaagctaacagaccagcagaagccatcttgaagacttaacaacatacagcaccttggatactttcaacaattaacttcggagatgtctgctgtgggaattgacttagctgggtagtggggaacccttccatgaggagtagaacactccttatgcaagattcccttctacctggctgggttggagtcatatcctgcaggtccttaccatgaagaagaagatgaaggcttggaggatactattcacagttttatttttctgtgcctggagtctctttgttaacatagataatcaagaaatgcccatacgtgttactgttaaattaggtgaaaaaaatatatatatatatttatattgtttagtgtaggatggctatttgaattctgttatagaacacttaagtagcaatgtaggctgatttatccttgggttttgtattttaaaaaatcagtttaggctagtatctctgatttgttagaagatgaagtgaaaagtatattagataaattcaacctggtggggaatggggaattaagcttctcttcttttatttctttttctagatatgaactatagctttttctttgtccctattgtgtttcatattagttttattaggttcttgtgattgtgtcctgtcctttgcaaatatttcttattgttcttctgtaaccactgctcgatgttagcaccatatttctttgattcacacacgttttttttcagattttaacatctttgaaattggattgcctctagtaattgatggcagcagttgagatacagttggtattgcctgcacatttgtgaacttgggcatgattttctacacgagtctaaaagaactcttgtgtgactataaaaccaaaattccgacttataagaagcactgtatatcatagactaattggcagccttttttctttcttagtggcacacagtataatggtgcaacttgcaattcctggtcagttccattcaatgaaatatggtatgttttgtaaaacaggagctcaacctatccatgggtgctcagttcttattactattccttttactaggagataagagacagtaagttggactaaacttaatattcatgtaaatgagtgacttatatcacaaaactagaccacaagcaccacggtcttaaatcagttccaatgtgtgaaatacaaagagaaaaatgaggaaggagtgggtgctgtgtttttatttgagctgttctggagactttgcaggactgacagttattcacagctataccgtaatttggtcccaagtgcaggatggacagttgtagcaatagtgaagtagtttccaacccgtacacagaatggcaatgattgttgctagcctattggctctaagacatattcttcatattcgttaacagtgtgatgaagcatggtggatttcgtttcagtgcaaagatgattttaaaaactatgggctttctcattcatgttttaatggagtaagcaatctcaagttatcttctgatactgacagcaatttgaaccaaaaatctggcagttttcttaacctctatgcactatagttgcttattggtaacctgggatagatatgcctaccttgagggctattctgaagattagaaattgtgcatgtggagtgcctaattcaatgccttctacatagcacacacttagttaatgggaattttacttaatcctaattgactgcctggcatactcatatcaactagtattgatatttggaaagaacttctaagggactgtgttcattaattttatttctttttaaggctgtgggtcatcttattgctgcagtcctaaaggaaaatggtttttcagaaaagattcaccaatctacaaatcaggtctgtgtttaactttatgctttaattctcttcagataagattgctactagctggatcacatatgcacctgtcttgtttccctgatagttcagatcacagtagaaatgcttttgaactgtgagaacttcattgccttttttgtttatttgtttgcctttttaatatatagcaataaaaaagttttaaatttattaaaaccctctaggaatgagacatggagggaagggctggagaggagtattcttatgactattaatgaaaaataatatgggtggaatgagagaaagcatgctttagagaagattgatagagttacctctgagggaattattttggtaatgaagagaatgaacagagtggctctgtttggatgtagatttctcatgcttcagctcagccccagctgtgagttcttagttggaaaggtcatacattgacagtcaaagctgaaaaattccatcttacacaaatagcaggtgaatgctcagagttgaagcaatgccagcttactgagatacacttggggtttggttgatcagtgttgtgtgttttgacctgctagttgggaaactcttcttttaagagaggtgttctcaggtgtcctctatagggaacataagtgatggaaataagattcttttttttcacagcagaaataaattgatttcctttgtctcacattctttttgattagctgctccaagttacatttctttattgcttctgcagacatgttgaagtaagtgtaggacacacttcactaattggcatttttctggtgtttgtatgtagtcatataaattaggttttctgaaaactctgatcctaatcctgcctataatcacattgtgtactttgagaagatctagtgattttacttaaactgccaggatttattgaatgtcaaatccctgtaactgtttcctcttctactaaaaatgaatgcttacacagtcttacctgaggcagcagtttatttatttgtttgttttgtttttccggtgtaataatagagtgatgacatttagaaccttttgatattgtcagtacagctgaacacaatgtccttatgaataaaaggagaagtggaatataaatatttccttcctgtagtgattgttaactgtattgttattttaatagtgggatgctaagatagaaaagattcttagccagctacagagggaaagtgggtacaaaatgatgttgattttcttttcttttttttttgagacagagtctggctctgtcgcccagcctggagtgcagtggtgtgatctcagctcactgcaacttctgcctcctgggttcaagcagttctcatatctcagcctcccgagtagctgggactacaggtgtgtgccaccacacccagccagttttttgtatttttagtagagactgggtttcaccatgttggccaggctggtctcgaacttctgacctcagttgatccacccgccttggcctcccaaagtgttgggattacaggcatgagccacagtgcctggccttgattttcattcttttattaatagttattctttgggagccgggatattaatttttcccaaattatatatttccctaataagttgcatcaggaaaaaggaaaaattgcttcattatttgttcttttttttttataatacaactgtgtgtaagtctaaatggactttatctgcaatatagtcatataggtttattgttagtagtgaaccattttggtggtcctggattcctgagaaagttataaaagctagaacccctgctttgatagggtattctaaaatgaaaacttatatttacttatatgtccttctcatgctcttctatcagtgaagacagagtcacagtgtgagagggggaaagtcacagtttctttcttgggcaaacagttttcctaggcttttttttttttttttttttttttggtagccatggactgagcagcttgctggtggcctgtcctacttctctctttatatctgggcccacgttagacttcaagaaattgtggcaagggcattgtgggtggtggtaaggtgcatgtaggtgatagaggttggtagtaggagagaaggaacatcttctgaaaataactgttattgtcattgaaggcttatggcataaatagtatttggagttcaactcaggctagctgatatactattagtgtctggttaaattgtttggttagagcaatgtgctagagccaagttttagctttgttgtgttgcttgaactcgggtcatacctctgcctgcagccagccttgttttatagccatgataccaggtgagagagagttgctgtatcaaaacacatccattacctctcttggaaaattgacttcattttattctaggaacagagtgacaacagcatcatctttataaaggaaagctagcctactgtgaacaaattactcattgatgaatgaccaaaggtgtgtgtgtgtgtgtttgctgctcatcagaattgtcttctaatcactggtttggtttcagactcctgctttgaacttgctgtgggagaagtgttgcagtgacaatgtagtggttcgaacagcctgctgtgaaggtctggtggcactcgttgctcaggatcatgcagagttcagctatgttctcaatgggatactcaacttgattccatcaaccaggtactttttcctcagtgtttggtcagttaatgatttaagtttttaggaaaaaaattcactaaatcactattaagagtcagcattcatcctacttgccagttgtttttcttgctcttaaaatgtcatgagttgctgtttcatatatgaaaatatcatgctaatttaaaccctatagtttcagaatttgtggtcatttgcggtacttaagttttggggctctacttaaatttgtcgttgccctttttaagaagaaaatagctaaacagtttataattcaaaaatgtaatgcagattcctgacattttaagaaagaaggttgtccataagcaatgcttcttccacagtggtatagtttatacattgtagtggcattacttggccaggccttggcattagtgtattagaaaataatggcatttatttctcaaatattttgtgatttagggatgtcttccccctgatttttcaaagttaataatgttttgttctttgaatttgtttggtatgaccatatttcgtccatttacagactgaggtaataggacaataaggaataagagggttccattcagaaatggtcaaacaggaccatgtttgaaccagtgagcctctgttataaaatactccctgaaaaagagttgtcactctttgcttcaagaaattgtcttgatctatatgtcctaatttttgactacttcaaatcatttgggcttttgcccccttccctcacctctcaccaagcctccctcctccttggtgaagctacttgtttttccagtgtttttcactcacctttattatagtatcatcgggctgagtacttaatttttttccctgccttcagtggagatggagtacagctgtaattatcaatttgtggaaagatgctggatgcagtgggtcacgcctgtaatcctagcactttgggaggctgaggcgggcggatcacctgacgtcaggagttcgagaccagcctggccaacatgatgagactgtgtctctactaaaaatacaaaaattagctgggcgtggtgatgcgtgcctgtaatcccagctactcaggagactaaggcgtgagaatcacttgaacccaggaggtggaggttgcagtgaaccgagattacaccactgcactccagcctgggtgacagagtgaaattccatcttaacaacaacaacaaaaatttgtggaaagattcctgggcttgaagttgattaggttaaataacccctagccttttaacctttctttataaatcgtttcctgtttccttagatcatttctttgtgtctttttggcaccttggtcttaattttgccctgttctgccctgccttcccctcccctccccttcctccccctcccctccctttccttttccttccccttcctctcccctccccttcctctcccttcccctcccctcccttcttttttctcccctccttccctccctccctccctccctcccttccttccttccttccttctttccttctccctctctctctctttctctctttctttctctgtttcctttctgactgggtcttgctatgctgcctgggcattattgtagctcactcaagcctcaaactactgggctcaagtagtcctcccgcctcagcctcctaagtagctgggactacaaatgtgtgccagcatgcctggcttggtttttcttttccttttgcagtctgtggttgcaaaaggaaaagcccttcccaaactagatccagccttctgttcaagttatgtttccccccatgaaccctcttctctagacatccacaactcttcagtcttcctgagcccttgtgtgtgttccacaccagcatggcatgctccttccccttctctgtctgacatcatctttgttatcctttcaggctgtgctcagatgtcctctttcctgtccagacacttcccacttctctgctgcgctaattgttgtttcacagtatgtgcctatgtgtgttatttttaaacctgtattttggtatctggcactctctctgacacttagtagatgcccagatatttctgaataagtgaaggtttgatcatgactgaaaacttactactttctctctttctgtttctacacgcattcacatacacgcatataaacacaaaaattttagaataattctattgtataccaattaaaaaagtagttttgaggagaattttgaaaagttaagatttttatgtgtctcttgttttctcatttattggttgatcttgtgcaagccacctagattttaccttaccttttttatttgtgaaatgcagggatggtattttttgccccccaccccacatattttcaaatgccttaaaaatctgcaaatgtaaaatgtaattgcattgtgtagttgtactatttatattcaaaagttaaagtatcagcagctcatggggccaatgtagtatcttctgtgtatttgaggtgtaattagagcaggttagattatacctttaattctagaagataatcttagaaaattatgctggtgtgaggtatcattcacacatcagtattaattcttcctccctattgtaaattgcaaagtataagctttgcagatagtgaattatcctgtcatctctgcatattataatttgtgggtaaccttggttatttttaaatttaaaaatgtgttttttgggtgaggtgcggtgactcatgcccgtaatcccaatacttcggcaggccgaggcaggcgaatcacttgaggtcaggagttcgagaccagcctggccaacatggtgaaaccctgtctctactaaaaatacaaaaattagccgggcgtggtgacttatgcctgtaatcccagctactcgggaggctgaggcaggagaatcactcgaacccgggaggcggatcttgcagcgagctgaagctgaaattgcaccactgcactccagcctgggtgacagagcgagacttggtctcaaaagagaaaagtagtgtgtttttttgaatagataatatattcacattggatattttaggcaaagcctctgtcctatcccagtatctgtgttttatcccccctgtggaagacaaactgttagtaggtcttattatattctatgtaatatataatagaaaatttgtatgtatgtgtatttacatgtatattttccttccttaacaaacagaaatagtagcctattacatagtattctttagtttgcattttcagtgaaaaaatatatcttggagcttgtattaggctgttcttgcattgctataaagaaatacctaaggctgggtaatttataaagaaaagtggtttattttggcttacagttctacaggctgtacaggaagcatggtgccagtatctgcttctggcaagggcttcaggaagcttacagtcacggtggaaggcaaagagggagcaggcatgtcacatggcaagagccaggagcaagagagagagggggaggtccaagattcttttaaataaccagatctcatgtgaactaactgagcaagaactcacttgtcaccaaggggatggtagtaaatcattcataagggatctgcctcccgtaattcattcaccccctaccaggcctcatctccaacatttagaatcatatgtcaacataagatttggaggggacaaacatccaaaccatttcagaactcattctataaaatatataaacagctttctattttttttctagctgcataatattccattgtgtggatgagccataatttatcaatttcctattatttctaatcttttacaatagatagtgtttcagtccttaatcttatacatataggtggccataaatttttaaggttctttggctatttggccaacatgtggaagaaagccttgaattttataataagcaaatataggagttttaacagtggaaggatgctggacattttaaacaagatttcttatctgagaatgttcatattgtctaaattgtcatccacagggagatatagacagaatagatgctgaagctaaccaatttaatttttgaatcaatttgatcataaaatatataagtgctaagttttccttattgttgccagtggatataataattatttttatgtcagaaaacgtaattttcttcatttgctttatttcaagtagcagaactttgcggtgtgtagtgaatacgaagactatactttgtaccgtttatgtttacaaaaaaaaaaccccaacaaaatgagaatccattttaagaaacaagctaattaaaaacaagacactcaaatagcctcctcctccaaaatgaacctcagggaatcttctgagacagaaaaccatctgtgtctttgggacttaaaggcaagaatgggccaggcgtggtggctcatgcccgtaatcccagcactttgggaggctgaggcaggtacatcgcttgaggtcaggagttggagaccagcttggccaacaaagtgtaaccctgtctctaactaaaaatacaaaaaaaattagctgggcttggtgacacatgcctatagtcccagctacgcaggaggctgaggcaggagaattgcttgaacctggaagcagaggtagcattgagccaagatcgcactactgcactccagcctggacaacagagtgagactccgtctcaatcaatcaatcactcaatcaatcagtaaaatgcagggaatgactttgggtgagacagtttgggtcttcagtttccattatttaaatttctacttgtctctgccttctctttaattagaggtttattggaatctaaaggcactttgggaactgagacacaccatgattgcttatctttgctttagaaaaatgattctaaaattttatctttccatcttgcctatttatcttctagcctactatccttcaggaactgagaaagagagaggggggtggatagaaaaagccaatagtgagaaacagccttctatagaatagatgtttagagaatgtagcttattgaattttttcagcatttagagcagattttgaaagcgtgaaagaaagatggaaggaaaagtagatgtgcccatctcttccagccttataacttgctccttcatcctttgtaagtctagtctataaaattcctttggaacacgtatggaagcccgcctcccacctgaatccaagcccacaatttgagaaacagtggcttagagcgggttacattgtatagtctaactttgaaaaagacttgacatttgcaatgatctggttgtctaaacttcagggagtggctgggaaagggtctggctgtgcttgagagactgttctcttcaaaggaatagtttcatgtcctagagtgttctctgttcaaagctgaggcaacatgaaacaattgtaaactcgtttttatagcttctgtaaacaaagaaatggatttaagagctctaaaatgttcttttcatcagtaaggaaatttgaaaaaaaattattccctagggagggtgaaggaaagaaggggaccacaaaagaaacacagtaaggaaatcattatcaccagtcgaatgtgaattttgaaatgaaatgaaactgaaaataaagtgaaagatatatagcagcatatagttttgtacacctttcaggaattgttttgagtttagattgtttttggttttgtttgtttttgtctttacattgactgtatcctggaatagagtcccaaaccatttttctttccttagaatttttttccccttaactgtgctggcttctagaaggctcatgcaaccattgttacagttgcttagtaacaggattgtgaataaaaaatcttgctctcctgcggaaccaggtattcagttttgatactgaggtgtcatgacagcctgtaatttcagctcaactgcttcccccatttcttgtcttaatgtgcttggtaagaaggttatactctggataaaccaggctagcacttgatttgtatgccttttgtgctctcagacagggaagggacctgcattcgaggtatttgggaatataaagtgtattaaagtgtattttctgagacttctaaagtctaccttttaatgaaatttagcataggatattaaaaattcttgtagtgggtcctaagtaaagctgttggattcagtgagtctttgatcatgggctgatgaaggttcagtggttaaaaatgattctgagaatcatttggagttaagatttaggatgatttatggagaaaattcttgtctctcagggtcttctcttttattgatgaccctgttccttgggaaacttaattgctttgttatgtaggaaatggctagcaactgtattcatatcttgttacattattgaagcttttctgtattatttagcttctttctctttattttatttggcaggagaagaagaaccaaggaaggatgcctttatgaggtttcctccaaggtttagggaagacagcacattttaatctgcagctggggtgtcagagcattactatctgaatttgatgtggtttcaaggtttatatttatattgatattatggcttatttaacttttagtagagagtgacagagttgctagtccatgtctgtttcccatcttgtcttttaaatattccttttaagcttattagcttgtttctagatgttctccttccttttgttccccaatccttttttttcccccttgaaaatcccagaatttctctcaactttcagttcctaatcagaaaagtggttccagccacttttctgatctagcacattctgccctatttctttttaagttagttgatctggttgaaggctttgtcacaaaatcttccattgtagagtcatgtatttatgctaagatgtttctaggtgatttaagaacagtggctactgaacacatgttacttttataatggaaaaatgcttcagaagaaatcaggccatttttggtacatggaagacaaatgagtgcacagaactttgttaggcaaaagctcagtaacattacatctcttagattttattttaaagaagcatttttttggtcattcatttaagcatggatttctcagaactgtttattttgtccgtgtcttcttgtctctgtttatctctttcatatagttttatagttttctcatatagttttataatgaatttagacaatgatttgattatttttctagtgtttatcattctcttgtttgctgatgacttactatgcttaagactgatgaattatcttgttcaggggtctgaaatcctttccagttaaaaagggacttggccacatttgttcccatgacacctagggatgcatccctcttgggatgttatgtcattctcttcaacccaaacccaaacccttttaattctacccctggtcaaatatgggtacagtcttgtacctcatgtttggtatattttgaaagcaaagaatcaagcattatttgtagtctttgaaaaagagacccagcatacgtgagcagtgtttagtgttgtaatgaaataattcccaaagggaatctgatacatgttattcatatacacagtagtaattatgccatattaacctagcaaaaacagtctgcctgagtgttttctagttagtgtagttggtagagcttgactaaaaattaaaaaaaaattttttttgaatcttcaacgtcataattgacccatactccctctcattataggctaactatcccctgtctgaaatgcttgggaccagaagtgtttcagattttatgttttttggattttgggatatttgcatatatataaagagatatcttggatagacccaagtctaaacacaaaattcatttatatttcatgtacaccttatacagatagcctgaaggtaattttgtacaatattttaaataactttgtgcatgaaacaaagttttaactgtattttgtctgtagcctgtcacatggcttcaggtgtggaattttcaacttgtggtgtcacatcagtgctcacaaaatttaggattttggagcatttaggattttggatttgttgattagggatacttagtctgtatgagaggtgggtcttggctcttatgcctagtgaaaattgtggcacctttttgcattgtctcttgctactgtgcttgtggcttagttttgaagtttcctttgctctctttaagggttcttgagtaaattcatcttttcctggcacctgcccaagaaaggacttattccagctgatctttattgtagacttttggcagcagtttcctgtgtggattaggtctctttgggctaccagttacagaaatccacttgaactagtatgagcaaaaatggattaatttttttgataaaggagtatgtatctcataggacccaagaataaatatgcacctaggcctcagaaacaaatgggatataaactgtgtgttttgttcttctttcttcctgcagactttctctgcctcctagttcacagggcaccacctgcccctggcttaacatctcttgtatatgaggcagccagactgagattggaatttcctggccacaattacagatttccaatggtgggacctggagctggatcagtcagctctgccaagtgttagttttctagggctactctaacacaagatgataaacttggtggcttaagacaacagaaatttattatttcatgatttcatgatgccttgcagccaaaaaccaaggtgtcagcaggactgattccttctggaggctctgtgggggaatctgttctatgcctttctactagcttctggtggttgatggaaacctttgacattccttgccttgtggccttgtaacttcagtctctgcctctgtatgctcatggctgacttacctgtatatctctttgtctccaatacagtatccctgtactttctctataaggataccggttattggatttacgacccacctaggatgatctcatcccaagatacttaatttaattatatctacaaagaccctatttccatataaggtcacattcataggtactgggggttgggatttagatgtatcttttggggggacacaatttaactttctgctcactgtgtcttgattgtgtgagcatatgtgtgctaggatcacttatacagtaaccatatgaatgcagagggtgtggtaatttccaaaacagagaggagactggaatgctattcctgaggagtcctctgcactggaactgaatttggaggagagccacatggaaataggtatttctcagcctttcagctctagctttgaaacataattgtgcttaaatacaagtgactaatactagatctatgttgctcagacagggatagaaggaggagagattgagtgaatggagaatcagtgtcaaatataattgtttaattgtggtggtgggatactgccttgacttcccccacctcccagaatattttctttaaattataaattatctctctaaacagcaataataatagaaacaaccactgctttgttttctaggggaagagggttaaggaagaaaactagcctttcttgaatataaactgtgtgccctgccttgtgctttagagctttacctaaaattccccacttaagtctcaaaacaaccctgggagtttgggggagactttttcttaggtgggattgtgttcttttctcaggaggacatagtatctgattgttttcatttttgatgatgttagcagctgttgatgctcagtgactagatccattaattcattagggatttcaaatggtgacattctaattctatgttttttttcttcacttattacctgaaatacttctataaagagaatcttccccatatctacacccagaggtataatttatataggaaaggcaggatatatatgtaattcttttatttactaaattccaaaataatgattttttaaagcatcctttcagtggtgaccagttacattttcttataaaataattataatgagcttatggatttaaacatacttgatgtatttcagtcctcttctcctctatttttaaggctgtttttggatccactctttagaagcagcttgagagaggagggtggaatttacaaagtttcaaaaatcttattgctattcagtgattttcatatataacaagtgagttaagatggaggggagtgaaagaaacagcatcttccaaataggacttcttgccccggtcttaatattaagtcataggaaccatctaatattcctaagactctcttaggaattaatttacagggtggtagatttagctatgtcatgggcaatcctcatagcagttaaatctctgcatacatctgaatatttctctcttacttttcttattccatcaggaatcttaagttggttttaatgttgtaggaatgtagattaagataagttaaatgaaaaaaaaacccataacaacaaaaaaactactttgatttctggctgagcgcagtggctcacgcctgtaatcccagcactttgggaggctgaggcgggcagatcacctgaggtcaggagtttaagaccagcctggccaacatggcaaaaccccatctctactaaaaatacaaaaaaaattagctgggcctgtggtgcgtgcctgtaatccctcctactcgggaggctgaggcaggagaatctctcgaacccaggaggtggaggttgcagtgagccaagatcgtgccactgcactccagcctgggtgacacagcgagactttgtctccaaaacaacaacaacaacaacaacaacaacaacaacaacaacaacaaagtacttcatttcccaatagaattcattgcttgataatataaggatattacatgaatttcatcttcccagtatttacagttatcctatttgctaaatgtgtgatcccttaaatgaaaggccttttagaaacacaaccagtaatagcattcatattattttgtaaaaaactaaataatgaattttgatattagagatcagatacatgaatttcagtgtgcatctataaagttatgtaaatatagaactagaaataccttcagaggttaccttgggagccaagcaagatagtacctgagctgtatccatccatccatctattaattaaacatatatttatatgtatttttttgacacagagtttcgttcttgttgcccaggctggagtgcattggtgtgatcttggctcaccacaacctctccctcccgggttcaagcgattctcctgcctcagcctcccaagttgccgggactacagacatgtgccaccacccccagctaattttgtatttttagtagagacggggtttctccatgttggtcaggctggtctcgaactcccaacctcaggtgatcttcccgcctcagcctcccaaagtcctgggattacaggtgtgagccactatacctggccaattaaacatatttattgagtatatttatttattattttatttttttaaagttctgggatacatgtgcaagatgtgcaggtgtgttacataggtaaacatgtgccgtggtggtttgctgcagctatcaacccatcacctaggtattaagcccagcatgcattaactcttttccctaatgctctcctgagtatatttattatctcttgtatttctgtgctaggtgctgtgataccgtggtgaggaatgcagacgtagttattgcactcatgatgcttttggtttcaatggagagattgccataattgcctagttatagaaactcattcaaagtatactgtgttgggaatgcctttaagatgacgatttgacttagtcatggtggtaaaagcaggctttcctgaggaagtgacacctaagatgagacgaaggagtaaataaaagttgtctaggcaaacaggagttggtaaaactttccagttacaggaaatagtatgtgccaagttcctgctgtgggaaggagattggctgttaagatggcctgaaagaatgctaagagtgaggggagagtggtatgaaatgaagctggaaaggtaggtgggattcagacagtgcagcgcatgattgacaatcttgatgatttgggtctttatcctgggtggagaaggaatgtactgaagtgttttatctagcgggtgttagtgattccacaaaaggccatttggaatgcagtatgaagattaaaatggaaagtattgggtttggggtaggcacctagatgggatacacagagattaggtggctgttgctgtagtcgagtgagaggtgatggttgcttgcactagagatgggggaagtagagggatttgtgagatatttaagggatgaagcattcgtggtgtactgaatatgtagatgactgaaagggatatgtcaaaggtgactccttgatttctggctttctctacatttagatagggaacattagaagaccaggtgtgtcgggggagagcatgggttcaattttggatgtgttgaatatgaggcacaattcagatgctgaagtggaaatgtctagtaggcagctggatatgcctttttttgttgatatcccctgaacacattatactatgaataagttaggcataatatctaatcagctcttttttgccctgattaaagtctttaccttgatttgttaattaactcttccgggtacctgtgtacctcaaactcatagagtctgcttatctaaagtctaattccagtccctaaaaatgttcctcagaaatctgctttttcaaattaaatgacatgtttttgtgtctgtgctaaactgtgactgaatacaggtcctaagcagaagacaccgtggttatttcattgtttatttcaatttctcctcatactgtctatccaggagatcacgtttaatttttcttttttttattattattatactttaagttttagggtacatgtgcacaatgtgcaggttagttacatatgtacacatgtgccatgctggtgtgctgcacccattaactcctcttttagcattaggtatatctcctaatgctatccctccccactccctccatcccacaacagtccccagattgtgatgttccccttcctgtgtccatgtgatctcattgttcaattcccatctatgagtgagaacatgcggtgtttggttttttgtccttgcgatagtttactgagaatgatgatttccagtttcatccatgtccctaaaaaggacatgaatttttcatttgtgttcaggaagtccttcctcactgggccaggcacagtggctcatgcctgtaatcctagcattttgagaggtcaaggcagaaggattgcttgaagccaggagtttgagaccagcctaggcaacatagtgagactctgtctttaaaaaaaataaaaaattagccaggtatggtgatgcacacctatagctccagatacttgggaggcttaggttcgagcatcacttgagctcaagaggtcgaggctgcagtgagctatagtgagctatgattgcaccactgtgctccagcctgggtgacagagcaagaccctatctcaaaaaacaaacaaacaaacaaaaaaagtctttttcgcactttgagattataaatattttttaactaatacaaaataaaagttgtgcaaacagtggaaattgtaggtaatggaagtcagtggtgaaactactttttgtcatcttttttttcttttcttaaaattcacttttgttattgagccctggtgaaaagtaggaaatggcaggactggaaggactcagggctaatagggagtcttaaaggttccttcaaatcttggtcttggtttctgctaggatatagagaaaaccagggtaatctgaagtcagatccaggtacatggaattaggaaccaactaaccccagtgacattgaaatcccattcctagacctataaaaaacatttatatgcacatatgccaagtgttttagaattgaatattccgttcaaatgtattttgtttttaaacttgcatttttccacatagtatgtgatggtaatttttccatgtcacatgcataaatctgtttgcaaccttattaacagctgtagagtattctgtttaagaggagtcacattttagtcattttcctaatgacagacatgtgtttttttctcttcctctttaaaagataacacatacagtataatattgtcttttttttttcttttttgaggtgatctcactttgtcacccaggctggagtgcagtggcgtgatcatggctcactgcagccccaacctcctgggctcaagtgatcctcccacctcggtcccccaagtagctgggactacaggctcatgccaccacacttggccagtttttgtattttttgtagagatggggttttgcccagtatggtctcaaattcctgggcccaagcgattcgcccaccttgggcctcccaaagtgctgggattataggaatatcttcttttgagtatagataagggtatgtctataggatggggtcatagaagcagaatttatgggaaaaggggtataaaattttcatagatactgtcaatttgctctgcacaaaggctgaaccaacatatcaacatgaaagtgcttacttcccccacctactctttaacactgagtattatgaatcttattcttctgtgatttgtgtatctctattctctgctcagtttgctattttatgatctgctttattttgttgcttttcttgttttgtgggcatgtatgctgtaaacattttatcttagactctctcttaactttgttttcactctgctaaaaactttccctaccaactttgctgaaactatctggaattttagttacagatttttctttttgttattttttacattttttctccataaattctttcaaagcaattgctttaatctttatagtcacatttgaaaaataattgtatgttctgatattcatgcataccaaagttacttgtagtctacatgctttttatttcttcagtcaatccttccttccttccttccttccgcctcccctcccctcccttcccctcctcttttccttctcttttccttccctgagacatgtctttctgtcatccaggtttgagtgctgtggtgagatcatagctcactgtaatctcaaactcctgggctcaagtgatcctcctgcctcagcctcctgagtagctaggactacaagtgtgtgccatcatgcttggcttattttttaaggttttttttttttttgaaacgggatctctctatattgctcaggctggtctcaaactcctgacctcaagtgatcttctggcttccagccaccagagtagctggggttacaggcacgagccactatgcctggcctcttcaattgttttatctttaaaaaaaaaaataacagcttattgggatataattcaaatattataaaatcactctttcaaagtatgtaattcagtgttttcagtatagttacaaggctgtgcaatcatgcattctaatttaactggagaacctctttaagaaaaattttcagagttttatgtgtgaaaatatttcttttctggtattttactcacttttttgggggaggtgtttggacttactgagttttataagcctttctcttataactccacatgcattgcttcattcagttttgttgtttgtagacaagaatgctgatgccaaattagaaatgatgcaagcctagttgtttttattttatgaatttttttgttttataaaatttaagaggttataggattttttttatcctttgagaaatgtcagcaattattttatttcagaaatcttgcttagtacttggaagctttttcaatttgaagatgtaagtgcagtgaaattttctttgacttttgcttctccagtggttatgttttcttctaattcactattttgagttttagcatgattcaaattactgtaacctctttatgaaatcatacagaattcaacaataattttcattttgcaggagtagatctcagatccagaataacaaagacttgaaaacaagaaaagcagattttgagctaagagatggaaaatactagagatttttaggagttaggatgagtttgtagttagttttaggcaaattccaggcctcagcgttcattaactctgatgcctgtgcttacacagcgtcatctgaaagagggaagaacattattatctttatgttatagtataagttttgaattatcccagctttttgaaaaagcatgtaatttactgacatactattctttattttttaaaacaacgtaagagatgggcttattatgatttttgattatgaagacgaggatgttgagacccctaggcattaagtgacttgcctaagattccctagttaattcaaattgaagtaggggtttaaataaatattaacctgaaagtatccctctcaacccatttgaaatatgtaaatcataatatttattaaacataatatttattaatataaataatatctatttcaagtgggttgagggggatagtttcaattaaatttaaggcaaatgtataaccatttgaatggcgctatgtgtaacttgattgatgccatcatctttcaaaaattataatctactcatgctacactcttgctgaaaatacagcattgactccgttatctacacaataaaatctggatccacagataagagtaagtgagacctaacttaaagtttaaaaaattggagttcatttatcagcattggtggttttgtgaatcccttggaattaaaagtaaatgtgatgtctattcttttctcttggattccactgctttcataaaaaggtaggacaccataaaaaccatagatctgttatctgttatctctagaactctagtcatatgacaaataaataattaaggaaaaccaatatagtttcacatgcaaaaaaggattatttaatgaatttgtattttttggaagaaattcagtcagaaattcatcaacactggtcatttcaactaatcattaggctcagagtgcagtcttacgaggttactaggtgaagcctggcctttcttcagtggtatataaatagcttaaatacgacttgaaagctgattttcagttgtatagacattgaaggctagaagataagaatgcttctaaacatgtagtgactctttctccaggacagaccaaagtagactccctatgataggctttagtcagatactggattctcagaatggctcacccaattagtgatgatgagattgtatatttcatggtatcatttaacatctaggcacaggcctgggtcagagctgcaggactgcatccctgagacctggtaagttagcttacaaaattcatatatttggaggagtcagatcccatagaccttcagaggaggctgtgtgaactctaccctgtgacttagtcgagacatttatacctaggtataggttcttgataaattggtgatagagcagttatgttgagggatctccaggtctttgtaaaggaaggtgttgtgaagagttgtgaagaactggaggatatagtgggagacaccagtccttatagtccagagttctcagttacaaaaagttctgattctgaaaaagtaaatggtgtgaagaattgcaaagaaggagtttattttaaaagtttggatgttgaggtatctttttcctaagctctggcataagaggagtctagaaattcagtgtcaatagagaagtttctcagaagaatgtgaacagttccaaaggaagaagacaaggcaataccttggttacccaaggaggtcctcaaggagatgccatgcagtcagactttcttgaggcaattacacttcattctagtttacaaaaagatttccattttaattttcactgagttacagtgagattcactggccattttgtgggccaaagtaccatagaattgacacagtaccaatgtgtagcatgtgagcaagccaaatcttgatttgacatccattggagaacacacacaggagagagaatctttatggagaaggcttcatgaagtgttgggacctctgtgttcaccagaggatccacacaggagagaaactatacacatgtgacatatgtcatgaaagattcatccatgagttatactgaatggtcctaagaggatccatatggaagagaaaacataccactgtagattgtgaaaaatgcttcagctgcaagagaaacctcaatactccccaaagaatccatttaggcactaaactatttgagtgtctacagcagtgctgtgaaatagaaatataatcttagccacaaatgcaagccacatatgtaattcagaattttccagtagccacattaaaaaaccagaaatagattacattaactttaataatatattttatgtagcccaatatatcaaaaatattatttcaacatgtaatcaatataaaaaattatacatggtatttaatattcttttttttgtgtcccaaagtcttttaaatctagcatgtattttgtacttacaggacatctgaatttggactaaccatattactagtgctcagtagccacatgtggctgttactatattggactgtgcaggtctactaagtggccaaaccttttgtcacttggaaaaccttaaatgccataaaaaaatacactcagtaacatctcacataaatgccacaaatgatacctaattaagtccaagtagtgttctaacccaaaaataaagttaacattgatttctaatcaactatgttctgaagtaagtgacataatgcaagaacttagaaaagtgcttagcttatggtaatgctcaataaatgttaacaagcataattaaacaataattactttttggctgggcacagtggctcacacttgtaatcccagcactttgggaggctgaggcaggcgggtcacctaaggtcaggagtttgagaccagcctgaccaacatggtgaaaccttgtctctactaaaaatacaaaattagccagatgtggtggcacatgcctgtaatcccagctacttgggaggttgaggcaggagaatcagttgaacccaggagatggaggttgcagtgagccgagatcgtgccattgaactacaggctgggcaacaagagtgaaactccatctaaaaaaaaaaaaaaaattactttttaaatttaacaaatagtgagttttttatttctaagattttctttatattttccagggagatctttatttaagaaaggcagcctatttttctttctgatatgtttatcctcttatctcttacaaaaataaggaaaaaatttaaattgctattccctttctattagctctatttcgatgggggttatttgctttgattgcttccctggcccactttttagagtggctgatccatttcatatatttggttatttttcatagtctgctaatatttataaatgaaatatttggtcattcggtgtgggcaaccaatgtggtcactgcttgaaattatgtgggctaatgtttgttttttcctgattgattttcccccaagaatgtgtaggcagatgattgataagttggtggtttgattctttagctccatttcttctcctttaaatgtgttggatgggtttgggctgtactatagaatgagttgagggcctgtgggtggctactgtttaatgtgggtggcaagtattaaaattattttaaaatgataggattaagcacctgattagaatattcactttttatctataacatttaacatgctatatttctttgcagaaatacacatggcttgataaaagccattatgcacttactacaaatgcaagctcttaaggaaggacaaggtggggaaaagaatattcagagtatatataccattaggtaagccttttttctgttttttttttaaacaaatatgaatttttaatgaaattattaactgtgacatgataatccagtaagaattagttatttaattcagcaggatatgcacacagtgattgtgggtgttgacctctcaggaagttagcgtttcaaagactcagaggattgagatagagttgacaagatgagtatcaccaatgtgggtttcagggttgctaatttggaattgaaatcttttacctaaaactcagattattctgtttactctagaatatgtaaccatcttcacagtattatgaaaatggaagacttcattgaacaaagatatttaaagcagggggggatttaggttaggcaggatggtaatctgccttactataaaaagcaataggagactgctatttccaagtgacttaggccaaggtcagtagttaggagtgttgatttgccttttctttgtcatctgtagaatgtaataaggtagaattgttttaaaaaaataaaatacacacagtagcaataatactacaatgcattggattttctgggggagttgtggtcaagggagggaatcatacttccttgtgaaggtgaccttacctattgccttgaaggacccaggaagccatctcttaagagaggggctctgagttagcagaggacccagaagatgcatgtgatcagtgtatgttgccctaggaactctgttcagtgaggcattcagaatgtgtctgcttcaaaagaatgacagcatggaaccataaagaagggcattgattcatgtggggaagatggcttacatgggctatggtgatcaaacagggaaaggaaatcaggtacttttgctgtgagccaccactgaattgatcttacagcacctgtagtcttcagtatttgacaacacaggtatcagaagtgtgagagagtctctcttcaaaatacagaggggtgtctatcacttacctgtatttatagtgctttctttttgataataagtaaacagtatctcatatactgtaaatgggatggtctgtgtcgtggtatatctcatataccatgatcttccgtgtaatttttagtgctatttgtgatctcttatttttatgaatacattattgtttcttaaggcatttttttaaacaaagtcatatttgcattttatattttttcttaacatattttgtgaatatcttcaaacatacaagttggaagaatgtggtacaatgaattaatttatttttaaataagggaagcaaaaggaaaattatttatttgaaaatactatgaaaacttgaggtctgcagagtaaagctttccaaatcggtaaatatgcttttttttttttttttttttttaacatagtggtgtcctttgtgacgtaagggtttattctttatccattgccttggctagaattgaacctgcagagtaaatgagcacattttaatatttctgaataaacatctgcatttcctcctttttaaaaagaaattcaaactcttgggccagagttcaggatagaaaataattcaatttagttgttgttaagatgggcttatttatttctaaatagggaagctattgaagtttttaattgaaatttttatgtaacagttttatggagatataattcacatatgagtgacccatttaaaatgtatgattcagtgacttttactccattcacaaagttatgccaccatcaccataatcaattttagaacatcttcatcatctccaaagaaattccttaccaattagccgtcactccatattttctcccctctcagggaagtatttttagttcaatgcttcccaacattggtgcccattagaaccacctgggtgtgcttaaaaagagacaaacatggtaacgatcaaataccctagataaaatgaatccgaatctccgccatgaggcctagtggttttaaaagtgtcctaggtgattgtcattcacaatgagtacaaagtggtgtgtcagctgctctaaaatgtgcatcctaattacttggggaccttgttgaagtgcagattctttttccttagtctagtgtgggctcaagattcttgtctaacaggctcccaggtgatgctgatgctgcttttgccctaccacactgttgagtagcagagctaccgccgcatcggcatacctgtgaacctgtgaagaatgcagaaccttggactccatctaagagtgccagagtcagaactgcattttagaaagattttctacgtaatttataggcaccttaaagtataagaagcatcagtttagatgatggtaaaaagaagttttctataatgcagagaatttgggttactctcattttaatcctgattgtcttcaccgtgtgcaattgttagacctttaattatctgtaatgtttgaccttttaattcattttttcctatagttggttcctttaacttcagtcttgtttcaaaaggcaattgctgcaaggtgtgaataggaagcctagtttgagaagctgagaagaattggatacataggcttgtctttagatacgtggcacattaagaggtccgtaatcaatcacctgagttggcataatctggtaatgtttatggagagcccttatgtgaatggccgtttagcactataaatcagtagagagtaattgagtgtataagagccttaagttcctccaagggggattgtggatggcagaaacagaggagaggtgagcctgaagagcatattcccctcaagagagctatgattacctgagtcaatcataaaattgtcatgctgttttagagccttctttgccacatgttggttagcaatatcatccagccttagagaggcaactgatgagctgtgtatgaaagcataaaagggatatgagaaacttagaactccactgagaggtgttttctggttattctgtaggattaatttaaaatagaaggagtatggcaaataagtgtaagctttctgagcatgcagctaatctgtgtttttatggtattaagcactgtgccagtattcagctggggcttaagtatttcttacttctttttcttctaatagctgattaatttgaatcacagtgcaacagaatacttggtcatcttaaatggtctgtgctgaaccaaataagttgtaccagtatgggagtggacagaaaacaagagatatgagaaccaagaatgttaggcggtggtttcccttagcccctctgaattttatgaaggagctgtagagatggtattctttttattgtacctagagcttagttagtggttctcaaacttgtcttgcataagaaccactggggcagcgtgttaaaagtacagcttctgaatcccacttgccagagattcttattcattcagtgggttttgtgtgaggctcagaaatcagcatgttacccatttgctcagtgatatggaaatatgtcatttgtggattacacatgagaactattgcttcagtatctgggagcttgatggttccatacgtgagcttcaaggtcccctttgaggtagactagaggggatcttgggtggcttacctatgcctccttttctttgtctatttgggtggcaagaagtctgtatcttcctaagtaccaaggcaccaagtttgtcttacatgtgtcagtcatggacaatagagaggccaagagcagaagcaaacagtgactgtaaaggaaaagcactccaaagagagcaagccaactttggatgctagagagaaaatgtaagagatcatgggtttgttcaatgaaaaaattccatggccccaacacatgttagtgttcttcatggtcagacggtgggtgggtggttgtgggaggaggaggggaagagaaccttgaacatcctcttagaaactgacacttgtttactgtgcataaggagctcatctttggagtttttaatgtttggagcatggcccagacttctgcatttttaacacgggatttgaatggaagtggtttactgaccaggctttgagaaacactggattagaatcatatgtagttaatgcagctcatattgcttaactggaccctcctttctaagcagtcttttctttagctttgtggcttaaacaagattaggcatagatatttaaataaggctgcaactctcagttacctttgtaactggaagcatagtgcagtacatttggctactgtgattagctaaggagcatatgccaagtataaaactctagacccatgagtctcaactctgtctgcacattagagccctcttaggagctttaaaatatatggatgactgggctttacccagaatgactgaagggttggtcttaggtgttggtatttttttaaaagcttcccacgtgatttccagcgtgcaggtaagggtggagaactgctggccaattgttgccatgaaacaatgggacttcattgttgccacacgttcagatctttcaatataaataaagtttttatgtgaaatctcctgactgaatgctgacaaccaattcaaacttttcaaaatgtagggtaggtagacaaaacacatctgctcacaagatgcaatcagtgggcaacaagtttgtgacctctgatgcaggtactattttcaagaatttcagaagccactttctagttatactaattaacatttttttaaaccactatgtagtatcctttagttcagactttctttttttctcccttttttatttggtctgaattttcttttgtttagctagaacccctcttttgtgtaacacacttatatttaagttatttaaacatttttttttttttgagacagggtctcactctgtcacccaggctggagtgcagtggtgcagtcttggctcactgcaacctctgcctcccaggctcaagctatcctcccatctcagctcccccagtagctgggactacaggtgcgacactacgccctgctaattttttgtagaggcagggttgtccaggctggtcttgaactcctgagctcaagcgatccacctgcttcggcctcccaaagtgctgggattacaggtgtgagccatggcactgggcctgtttaaacattttctaatattgatcgtgcaggaagtgggcagagaatcaatatttcgctagtgttttggttgcagggaagaataaataaattttcatgggttgtaaattattagaggctcattttcttatttgctttgtaagatgccatttttcccctaaattttatcatgtgcttttgcttttaattttttctctgcatattcatattatggcaatcttttaaagatctctcttccctcagctaaagtgaggaaatagctgtgaattcatgagcagtaactgcttgttccagaattcgtgtatttttctgatgtgccagacagtggctgacatgcacaaatatcaaatgttaagaatcttatttgtgggaaggtttggtctggtaaacatgaagctgtactttctgaaataagggaatattaaatgttcgtggcagatggtgtgctcggaagtggacaattaggccaacagtaatggatgattgtaccctgagtagattaaagttatgtgctctatgtttgtatttgttcatctatttgtgtaatagtatatagtttatttggagggagagttaagtttaaggacttaaagacgtgtatcctaaaggctgagattttgtaatttatattggtttatttccttatcactgagggcaaatgtgttcatcacttaaggccatcaaataaagaaaagcaatagcaagtccaagataaatactgatttaagtgcgcaaagaccagtgtgtggttgtggatatcaaaatgtagccccatttttaatttcaataactagctttttaagcattgtttttgcattttctcctattgtctgttttgaaggaagacatggagccagctgcatgaagagtgtttcagaggaaggaaaagcaagtgcctagaagcttggcacatgagaggaactaacaggaggcagagtggctggagtttagtgctctagggaggggaggccgggacattggctcaggagaagtaggcacgggctagaatatgaaaggccatggcaaagaccgggttttacttaaagagccgtgggaagtcattaaaaacatttctttttaacttactgtattgaaataattttaaagttcgagaaaagttacaagaatagcaccaaagactcccatgtaccatttacccagatttatcagtgtttttgctctttgccatgtttgcattatcattatctctgtataattaataaaaaccatttgagagtagattggaaacattcaagagtgtgttttctaagaacaaggatattctcttatataaccagaatataaaattgaacattgatataatactttttataacatacagtccatattccagttttgtctgttgtctcaataatgtcctgccttttgccgccttactttttaatgtataggatctagtttaggatcacctgttgcctttggttgccatacctttttagccttttaacatctggaactgtttctcatcctttctttgtttttcatggtgttggcatttttgaattccatataaatgacgctgtgtccttctgaggttaatcacatctggaggtactggtgtccctcttgcccctcattggggattttaattttggctacacagtcgaggtagtgtgtggtttctgtactgaatagttatcatttttttgaactaataagcaatctgtggggaatacattttgagaccatgcaaatattctgctcctcattaagctcagcactcccaaccaattttcactgtgatgactacaaaatggtgattttcccaactccaccactccctttatgtttattagtggcaaaagagatagctatttggtttagaggtggaaatgactattaagctatcaatcaaggatattaaggagatatatcagattctgatttggacttattttctaagggaaatccaagttaaatttttttttacattagcagtatacttatactgctgataaatgtgctttctaaaattaaaaatagtatgtggctgagttaagtctgaaatattttaaatccctttttattgagatataatttatgtactataaaattcactcttaaagcgtacaagtcagtagattttattatagtcaggaagttatgtaaccataatcactgtctaattccagaatattttcatcaccccaaaaagaaacctcatacccgttatcagtcattccccaatactctctattcccagcccctggaaaacactactatttgtgtctttggatttgccttataagtggaacaatacagtgtggcttctttcacttagcataatgttttcaaggtttcattcatgttgtagcatgcatccatacttcattccttttaatccattccatagatataaaattttatttatcttggaattttttgatgctaagaccatttgcatttttagtgtttttttttttttgccttttatatatattttaaaggtaaactactttttgtaagttattgaaaatgaactgtagtctttagagtagtttagttattgtttttcatatctacatacatttcattattacatttactgtttcttaatgatgttgctcatcctctaactcttaaaaaaatcgacgatcagctattatcttatggttttattgtcaaagtgagcattttgcttttggggggttgattatttcattacttgaatatattacctgaagggatctcctgaggtataaatgtttggttttacttagcataatgtaagtatgacacctatacaatcaagctgccataagggattgaaaccagtggaatacattaatacaataattaattttatttttattttgctgaagttataacaacttacactcagggagccaccatttctggacagaacatatcatataactttttaaatttttttttggaaatggtctttatagtttttttgaaagcaggagttctaaggagactgagttgtagcaactacctaagatatacttaggtttaatttactggtatgtagccttttttgggagggtggtcaggaccttcttaagaattacataaaagttttggactttctcctattatagaaaatgtacacatgcatatatactaaaaattttacatatggtttcagagggcttgtagaaatcattatagaaaaatcagagaaagaagatgggaaaggatgtagtcagattcactcctgaaaaagcccaatggagttaaggataaagaggaaggtagggcagtaattgagaaaacatagctagtaatacttttcaagggccatctgtctctttgcagttccattctttctctctagctacatgttttgctcctgtttttatttcctcttttccttcttcttttccactcaggaaagtctttattcacaatttatgggtctaatcacctggggtttacacctaagatttataatcagacttttagaataagctgcacccatcatacagtcttccagttagcagtagccaccagaaaacactttatatgttcttctaattgtagatgtttaattgaaagattgggattataatttgctgctaaatgtctttaaggccacaaaaatgttgtagtttttgcctattatcctatttgtttgtctctaggtgttttttttcccccagtgatcatagcacacaacttaatgaaaggaaggttgtggatccctaagtacatttatgtttccccccaaccaattactttgtacttaaaatagttccagacttctgacattggcaggcaccattgcattaaaaccctggctctctaaaagggattctgggaaaggttcattgttgggggagaatcgttgtaataggaagtatattttcacagaaaggaatcttatgctgtctctgccttatagactcaaagaaaaggtgttgtgactcaaaaatgacaaaattaaagttgctttgctcgaagtctttctaggagcttatgtgggaaggataaagatgcatttgtcttaaaattgtgttgtaggatatatagaaattcacaattattgtttagtttttccttttgaattattatttcttctttatagtgatattcatggtggaatcttcataatttttcgttatgcatcttctaacttaaaatctgcagattaaaaaaatctctttttagcttctaaccagcagtttcaaataaaaattcagagcaggtagagaaatgcttttaaaatgcatatttgatgtagtaagtgctatgctatgcttctgaaagcaccagggtcacagctgcatacatgaaaatgcatggtgactgcaggcattgtttcctcacacagaaaaggcaatctgtgtctgtcgctgaatttatgatgtaaatcaaatcatagctttcctatattcagagatgtagcaagaaggttgaggtgacctaaaggttacaaataacttttgctttttgatttgcctatcacagactattttttttaaccccctcatttctattaggattgatgtgtttatacttggaaaggtgaatccagttacagattttatcattgcctctgtgctagtctgggggaaccatgcatttatcattcactccttcctcactccattctgttaggatgcatgtactgtactgctctgtgctgttgatgatattaataaagagtgggaacactgaaatattaggtaccaactctgtgtgcttcctctgcttttttcttctctgaacagtgttgactttgggacaatgtgctagagggactgtgttaaattggcttcccatgatcctgtttattctgtcatttgcaacaacatgaatcaaccagtttaagagtttaaaaaggtgatttggggaaagtgtgtatgtgataattacgtttattgtagataggcatttggcactgaaagggaaacaaaaagattaagaagacacatacccagctttcatgctgcttatgctataatttaataaacaaacctatcttgatgataatcataattgtacccacttatgtagttcttctatttgctagatattatattaaatgctttacttaaaatagcaattaaaatatttgcaaatcacgaaatggggaagtgccaaaggaggtacaacaaattggatcatctattgcagaaaaacaacaacaaaaaatgcacacagtgaaggagacattagaggcactagagaccaatgaagggtgacctgactgcctggtttgtattgatcttgatatttagaaataatacaattctctattaaggagaaagcagaatctattggctatctcaggagttaggaaattcagattaaaaaatttctgtgggctcttcctggacataacacttccttctgaaataaaaaaatatagggtgatttatctctgagctaaaaatagaagtccttttttttgaggacttagattttattagacattgggcttagagccatttaagcttggcatagaattattagtagctgagagctgccacctttaatactttttgcctttacagggtttgtttgcatctgtagtcctgagcagtcttaaggttagggttttaatgggtggcttgggttatacagtattcgctctggaaagtatttagtctgatcgccttattttattattggtgaagaaactttggccaagagaggttaattctcttgcttgagatcacttgatttgtggcagagccaggatgtaaatttggaacttttgattcttttaattcagttcttttccctcacaattttatctcacctctccacttccatttttttttttaattattgttatactttaagttttagggtacatatgcacaatgtgcaggttagttacatatgtatacctgtgccatgctggtgcgctgcacccactaactcgtcatctagcattaggtatatctcccagtgctatccctcccccctccccccaccccacaacagtccccagagtgtgatgttccccttcctgtgtccatgtgttctcattgttcaattcccacctatgagtgagaatatgcagtgtttggttttttgttcttgcaatagtttactgagaatgatgatttccaatttcatccatgtccctacagacatgaactcatcattttttatggctgcatagtattccatggtgtatatgtgccacattttcttaatccagtctatcattgttggacatttgggttggttccaagtctttgctattgtgaatagtgctgcaataaacatatgtgtgcctgtgtctttatagcagcatgatttatagtcctttgggtatatacccagtaatgggatgactgggtcaaatggtatttctagttctagatccctgaggaattgccacactgacttccacaatggttgaactagtttacagtcccaccaacagtgtaaaagtgttcctattactccacatcctctccagcacctgttgtttcctgactttttaatgattgccattctaactggtgtgagatggtatctcattgtggttttgatttgcatttctctaagggccagtgatggtgagcattttttcatgtgttttttggctgcataaatgttgtcttttgagaagtgtctgttcatgtccttcgcccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttccagtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctccatatggctagccagttttcccagcaccatttattaaatagggaatcctttccccattgcttgtttttctcaggtttgccaaagatcagatagttgtagatatgcggcgttatttctgagagctctgttctgttccattgatctatatctctgttttggtaccagtaccatgctgttttggttactgtagccttgtattatagtttgaagtcaggtggtgtgatgcctccagctttgttcttttggcttaggattgactcggcgatgcgggctctattttggttccatatgaactttaaagtagttttttccaattctgtgaagaaagtcattggtagcttgctggggatggcattgaatgtgtaaattaccttgggcagtatggccattttcacgatattgattcttcctacccatgagcatggaaagttcttccatttgtttgtatcctcttttatttccttgagcagtggtttgtagttctccttgaagaggtccttcacatcccttgtaagctggattcctaggtattttattctctttgaagcaattgggaatgggagttcactcatgatttggctctctgtttgtctgttgttggtgtataagaatgcttgtgatttttgtacattgattttgtatcctgagactttgctgaagttgcttatcagcttaaggagattttgggctgagtcaatggggttttctagatatacaatcatgttgtctgcaaacagggacaatttgacttcctcttttcctaactgaatactctttatttcctcctcctgcctaattgccctggccagaacttccaacactatgttgaataggagtggtgagagagggcatccctgtcttgtgccagttttcaaagggaatgcttccagtttttgcccattcagtatgatattggctatgggtttgtcatagatagctcttattattttgaaatacgtcccatcaatacctaatttattgagagtttttagcatgaagggttgttgaattttgtcaaaggccttttctgcatctattgagataatcatgtggtttttgtctttggttctgtttatatgctggattacatttattgatttgcgtatattgaaccagcctttcatcccagggatgaagcccacttgatcatggtggataagctttttgatgtgctgctggattcggtttgccagtattttattgaggatttttgcatcaatgttcatcaaggatattggtctaaaattgtcttttttggttgtgtctctgcccggctttggtatcaggatgatgctggcctcataaaatgagttagggaggattccctcttttccacttctattttcttctgagatatggacatggctacataacagtaaatgattatgatagtgttctgtagccactgcatatattaatataaataataataacgatgataatgtgcagtgtttgtgtttattttttcaaaacttgtataggttattgtctgctactgttagatttatttacaagtgatcgggctgattcatcagcccatctatccttttgaataaagtgttgttaggcaacttagtattcataacttgaatagctggtttggggataattagaaatttgaggcatgactcaggttgtgttttggcgttctttgtaccacattcttcccttttttgatcagtaatgcttccaatttaaagttgttaacttgactcagttaaattgtggatcctttcatttaccttgacctttctcagttggatgtacttgaaaaaatggaaaggctaacaagcagtgggtgagaggaagaaagtaaagaaaaatcttgagtaatccataaatgtaataatcaactcttgaatacagcaagactgagcaatacttagccttatggaattttaaatgctttaattataattttttaagtaggaaaataacttcattttctatcatacccaaattagcatgaatattctttaatgccttttattctatgttttccaaaggaataattttacatttgttttccattttaagccttctagtttctagtgtgttctgttactcttgtgcatccagtttgataactatatttccataagaaaatcacaactctgatcttgatcgattaactacttttcattcagtgttaggaaaggtgaaactggaagcatagtgttttttttttttaacaatttgggactggtgcaatgctttcttcggtgatgtgccttccatagtgcttgtcatttactcaatggagtgattcttgaccaggagcaattttgtcctccaggggatatttggcaatgtctggagacaattttgattgtcatgactaggagaaatcctacttgtatctagtgggtggaggccagggatgctgccaagcattccattgtgcataggacaacccacacaataaagagttatgtggcccaaaatgtcagtagtggtaagactgagaaactctcatgcatgggcagttgtgcaatgaagtttattgaattaaaaaatacatccattatattacgtgagcctaaggctttatggattattttatatatgtattacacaccaatttgatgactcttaagggagaatttagctgtttgcttcattatgattaaagtattaaaattgtggcagttataattgattataggttagtatacttagttgaaatggtatgttagtaatcaaatgctgatcaacaggaagattcagtgttctcctcttatacttcccttttccctcaagcttttcagcttcttagaatcaatactgtgtatcatcacctgcaatattgccactcagttctgacataatcaattatttggaaaacttaattatccagatgtctaaatcagtaattaatctttatgatccctatcctactatattctacttaatctcattttttgaatttaggtctgagatactaaataaaatctgctgaatccaatagctagcaaaacaggccttcagcatcatgcaacaaagctggagtggctccctcggtatgcataaatgtaaattagaattgtttgccacatatacatcacttttaatctcattttatactattttttatttctgttgacctgattcaatttggacaaaactgagtattttaaaaaggagatagattcttagcggttttttttggtggggtgtgaaggatggaagggagatgacttataaaggaagaatattgaaaagcacttcggtgccttatgaccatacaaaaactgtgtgataacttgttgagttttctttttaaatatttataagtgccaccattatctggaagattaatggatgattatatctgatactctttatagcgatatggttcttatcagaagaacccaaagctgctgaaataattgtaggtgctatttctgctgtttcttcctttttatgtagtgagtgtttttttgtttgtttgtttgttcctttgtttttggtagagactgggtcctgctatgttgctcaggctgatgtcaaatccctggcctccagcaattctccagccttggcctcccaaagtgctgggattacaggtgtgaatcactgctactggcctgttttgtggttttaattgaacacgacctgctgaactttcaatctaagaatttcatctgatactacatacctgagaggcttttagaatttgtaatatttttcttagtatttgtggcaaccaaagtggaagcaaattctaggtaggtttaactgccaaagggtttggaattgggaaacatgaatgattttgatacgatttctgagttttggcataaaaagttgcttggagtgatcccttagcaatggtagcattcccgtcagtcagaaatagcctgtgctttagcaagcaggaggctgccagcatgtgaagttagttagtacatgataggttaggtgaggttaagaagaaatagatagtgttatacccacaaactgtgtggtagtgtcagagaggtgtttcacatgtgtttcaatgtgatagatctaatgtactcttctgtttttaaaagagaaaaaaaaatagtacatttcccacccccaacacccgtgcagtagtttttacttgtagcagttctgaatcctggtaacatattaaaattacctgtagaattttaaaaaattgctaggggacaaacttcattcctagcagtctaagataacagacctgggcattagtattaagggctctacagctaatctaacttgcaaccaagaataggaaccactgctttatagcagtgcatcagaatttcctgcagggctatttattaggtctgggctagggcttgagaatttgcatttctaacaagttcccagttgatcttactagtaaggcatcacattttgagaatcaccatgaaggcaatcttaaaaaatcatctgagtgtaactgatggtctgattgttactcttttttgaaaaatcattgctggagatatattaaaattaaagactagctccgtgtatgtggttccttttatgctaaaaagattgatatttctgtattgtttgcatgtttttacaatgagcattttaatgtttttttttgagatggagttttgctcttgttgcccaggctggagtgcaatagcataatatcagttcaccgcaacctccgcctcccaagtttaagtgattcaccttcctcagcctcctgagtagctgggattacaggcatgcgccaccattcccggctaattttgtatttttagtagagacagggtttctccatgttggtcaggctggtctcgaactcccaacctcaggtgatccacccatcttggcctcccaaagtgctgggattacaggcgtgagccaccgcgtccagccttaaatcttatttaaatattttcttggaggaaaaagccacataaataatagctaaaaattgtatagtacttaatagtttaaaaagctgaccaatttacaattattagtagagtagcctttttgaactatttaaaataactcatggttgtactttttgtttttttttggggttaaaccccattctttgagaatccttcaaatttcagattttatgttttatatagtctctttaggtatcttaatagaagtagctcaaataaacggattcatctgcattcaacagaaattttatgcatcttcagtttggatagttgttaagatggaaggaatatttccttttttctattcttaaatatgctggggaagcgcagaaccatacaatgggaataatgaagtacctggaaacagagagggagagacagagcttatgggttcgggtaaggttggaggaaatggaacttaccaggcttggaaagagagcagcggtagcaggaggaggaggtggcttgtaacctctaggaatgaaggatcaaggggatggatatgagagagctgctggattcaggagcttggccaaagtcacagaactgttaaatggaagagtccattcccagatttggatctctgaggctcctgtgtccattttgttttctgcaaaaatgttaggaaaaggcaggggggagagtcagttctgatgaaccaactctgcaacaaatggagcaagtgatcattttgtgacaattatgaatcgtgaaaaaagtctctagatggtaggtactggcttctttgctgctatatttggatattgaaaatgtgtagtcctgaataacaggttcccatgtgactttctgtgtctttcagaaatcatcctcatcctttgataactgtgcttgaacacagacctgattgctggccagtgtttttgcagcagctgacagcgtttttccagcagtgccctgaaaggtaatgtaaaataaaagtgtaaaataaagtgagggagacagaatggtatatgctaattttagagctagggtttttttttgtttgtttgtttctttttagctgctttgatctataatgttttctcctgaagaaccatcctagagcaggttgtagttttcttttctttttaaatttaattttattattattatactttaagttttagggtacatgtgcacaatgtgcaggtaggttacatatgtatacatgtgccatgctggtgtgctgcacccattaactcgtcatttagcattaggtatatctcctaatgctatccctcccccctcccccaaccccacaacagtccccagattgtgatgttccccttcctgtgtccatgtgttctcattgttcaattcccacctataagtgagactatgcggtgtttggttttttgttcttgtgatagtttactgagaatgatgatttccagttacattcatgtccctacaaaggacctgaactcatcattttttatggctgcatagtattccatggtgtatatgtgccaacatagtgttggaagttctggccagggcaattaggcaggagaaggaaataaagggtattcaattatgaaaagaggaagtcaaattgtccctgtttgcagatgacatgattgtatatctagaaaaccccactgactcagcccaaaatctccttaagctgataagcaacttcagcaaagtctcaggatacaaactcaatgtacaaaaatcacaagcattcttatacaccaataacagacaaacagagagccaaatcatgagtgaactcccattcacaattgcttcaaagagaataaaatacctaggaatccaacttacaagggatatgaaggacctcttcaaggagaactacaaaccactgctcaatgaaataaaagaggatacaaacaaatggaagaacattccatgctcatgggtaggaagaatcaatatcatgaaaatggccatactgcccaaggccattaaaaactactttaaagttcatatggaaccaaaaaagagcccgcattgccaagtcaatcctaagccaaaagaacaaagctggaggcatcacactacctgacttcaaactatactacaaggctacagtcaccaaaacagcatggtactggtaccaaaacagagatatagatcaatggaacagaacagagccttcagaaataacgccgcatatctacaactatctgatctttgacaaacctgagaaaaacaagcaatggggaaaggattccctatttaataaatggtgctgggaaaactggctagccatacggagaaagctgaaactggatcccttccttacaccttatacaaaacttaattcaagatggattaaagacttacatgttagacctaaaaccataaaaaccgtagaagaaaacctaggcattaccattcaggacataggcatgggcaaggacttcatgtcaggttgtagttttctattttcttttaaagagtaaaagaaaaaaatctaccagatttattggttgttgaaatactgaatatgagaaaagctgttattaaggaagttaagcattggtaagtggttaggaaagttggctagaataattcagtaagctactacacaatacatataggagataagttcttccccttggacactggctaatgagttagtctctccattagaaaactgccatttgagataaagtattactgccaagtgggatcagatagccaccatatgtgcagttagtgtactttcaccaaggcctcctgatggctctcaaagctactcccctttcttctatccttactaccatgacgctggttcagggcctcaatatctcttgatgtggctcttgccacctgttcctaactggtgtctctgcctccagtcttgtcctggtcaaatccagtctctaaacatccctcagaaggatatatcaagagagcagatcttacagtatcattcccatgcttaagtctctgtggctgtggttttcaaactgcacttgcagtgcatgggctaagcatggagcatgttcccacccctttggctctgttttcatagcacttacttgttgatatcttatggaagctttctatgggaaaacaaaaaggattggtttctgaaacagtttgaaattccctggactataggataaaatctaatatgtcatagtaggcttagtatatgatgcagttccaatctatctcaccagctttatcttttcttatcttcatctcgcagtttatgctttagcagtacaatgacttgccttgtgttccacacaggaagcagtgctgtttccttctctccatgtttttacttactggtatctactgtactctcttgaatcttaccccactctctttctgataaatgtctttatttgaaatctctgtttaggcattttttttgccctagggtcttttcttactagaagctgtattaggtgtgtctcttgcatggttacataataccttacagttgcgacattatcataattactctcctgtattaactgtgaaatcttgagggcagggactgtgtttcattattctctgtattagtgatgcttggcacatttctaggtgctttataaatgttgaatttctttaaatgaggttgcagtgagcggagattgtaccactgcacttcagcctgggtgacaggttgttaatgagtatatgagtagcgattcacaactatgggaagaaagcaaaatgttgtaaggatagctagctatttatgttcattttaatattatgtatatgtcctaaaatgacaatatatcttcatgctagattttttgggggggggcgttacaattattattatttttaagagattgggagtctgctgtgttgcccaggctgaacatgaactcctgggctcaagtgatcctcctgtctcagccttctgagtagctgggactataggcatgcacctctgcacacagtatttgggtattattttataattaagttctgcattcatttattgaaggcctatgactttaacctttcaggaactgagaatttgagaatggtgcaaattgataatatcatggattttaggctgggttactttaagattatctagtctaacataatttttcagatgagagaaccgaggagagcaacattaaacgacttactgaaggtttcttggctagctagtggtggagttgggcctaaagcctccgttatttttatttttatttttttttgtggcagagtctcactctgttgcccaggctggagtgcagtggtgcaatctcggctcattgcaacctctgcctcacgggttcacgccattcttctgcctcagcctcctgggtagctgggactacaggtgcccgccaccatgcctggctaattttttgtatttttagtagagatgaggtttcactgtgttagctaggatggtctcaatatcctgacctcatgatccacccgcctcggactcctaaattgctgggattacaggtgtgagccaccgtgcctggcccaagcctccatttttttactctctctctaggtctgttttttttagtacttctccctctgtggtgaacttaaatataaaagacttgtgtgtaggtacatacataattggttacatttgaaaacattttaaatcactttgggatttcagattatctgtttttttaatattcattttttcctaagccctggtaatgtcttactccaccgaagtgatgattaatcatcagataccacatgcagaatctaaaatcagaacagattaagccaaggggatttttaaatagtatattgtccttaaggaagttcaacgtttgctcctgatgtcaaatcataatggcatcttggaaatgtatttctttatatgaaccttacatttcaccttcagcatctcaaagtagaagaaaaccgataagccatccatggatgctgttgacacccggatagtatttattctttggggaatacattattaaagagagatggagaaggaagtttcttaaatctcttttctgggaactttcactttgtatttcatacatacattatctgattccttcatctatctttttttagtttccgaaagtagaaggtgtgataaagatatatgtttcagtaataattttgaagtgaaaagtccttttgatttttatagattgtataagtatttgagcttatgataaaaaaatttcttcagactgtgagctctatgagagcaggaacttaatctatttttatttcttgttttgtttccatcatgtagatgagtgaggtatactgtaggtgatcagtaaattttaccaagtgaataaattaatgaatgaataaaatttaattggcttggtaacttttacatttttattaatcttaatggcattttgaaatcacattgctatgaaatgtatggtattgtaagactatgttgtcaagtgttatttattttattataattaaaaagaattcccttttattttagattcaggggtgtatgtgcagatctgttggaagggtatattgtgtagtgctgaggtttggccttttattgattctgtcaccccgtagtgaacaaagtgcctaacaggaaaattttcagcccttgcccctccttcccaccctctgtttggagtcccttgtgtctgttgttcccaccttcatgtctgtgtgaacccaaggtttagctcccactcttaaatgagaacggtcaagcataatttaaataccgtttcttccgtgaagcaattgcactttatacctttcttttggcagttgtcactttctatcatctagttcaggatcataactgattgtctctgtcagactgtatgcttcttgaggatagataattcttatttcatctttgtatcttatctaatcattccttatatataagaatgtgaaaaacattagaaaataaagtcatgacatttaattgcatgctcattataaaactactctgtaacttagtgtaactgaattaattaaatgattgagcatctctttgaaggcctagtatgtacagttattggtgataatagcagtaaacagaaatccgtggcctcatttggtttatagtctggcagggggatacagatattaagtatgtaataataacagcttgtaatctcagctacttgggagactgaggcaggaggattgcttgagcctagaaattcaaggctgaagtgcactattattgtgcctgtgaatagccattgcactctagcctgggcaatgtagcaagacactgtctcttaaaaaaatgtaatggcaataaaggcattgtatcttaaaagcacatctgatgtgatctgatcaaggtgaagtgtcaaggaaggacctgagaaagtcattttaaagcagataactgaaggatgatagaagctaggtagggagaaggaataggacgggtagaaggggagaatattacaggtagagggaatagcaagtgagaagaaagcccagatggcttgataaagacctgaaaggagtttagtgtggtttagtggtgaatgaagagcaagaaatgaagctggaaagataaacagaggccaaatgatggagggtgtgtgtgaattgggctagatactgtttaggctagttaatgacatgaccatatttttatttttgatgatcattccggtgttttagtgaatttggactaggagttttcaggatatagtgaaatctaaatagatacaaaagatttgtagggtgggaagtgcttaagaagaccttgacaaattatttcacctctctctccttcagtttctttatccgtgttataaggataatattattttttatttcatagggttgtggtgaggattaaatggatttaaagacataacatgcagtaacttgaacactgtaagggttaacaggttaacaagtaaatgttaactgtcatcataatcatcttgggatgtttgtctggatttcttttatgtagatcctcacctgtagagtttttccaaaaattcatgtttgtgtcatactcctggagaggtgatcctgacatctgtaattctagaaaggttgtcaggtgatccttttttttaagatggagtctcgctctgttgccaggctggagtgcagtggagcaatcttggctcactgcaacctctgcctcctgggttcaggcgattctcctgcctcagcctcctgagtagctgggactacaggtgcatgccaccacgcccagctaatttttgtatttttagtagagacagtgtttcaccatgttggccaggatggtctctatctcctgacctcatgatctgcctgcctcggcctcccaaagtgctgggatttttataggcgtgagcctccgtgcccagcccagatgattcttgtgttcactaaacactgatttcagagatgtagttgctattctaatgtgcaaatagagactgtcttcatcctgggcatctagcttacagtctccaggtgttgaataattttcctcagtgtacaaagaactgtttggcatagatgtaggcaggtcatagcggaatagaagaatcataaaaagaagttacacttgatgatatggtagattatgttatgtcatgaactataagttgatatttgccacttacctgcttgatagtgtgtttaactcaataactggctaatgtatttcatgtcttataggttagaagtttcatgcattcaaataatggcaccatttctgtggtatctgtattgtgaaccatctcagttacaagaatatgctaaactccgactagccctgctgaaagtcttacttcaaccccaggttctttgtgacaaagatcaaccatcaatactggaacagcagatacttcaactgtgttgtgacatagttccatgtttgcaggtaaggtctttgtcctcctccacaaatataggtcagcatcagtaagtgttgttattgtcatagacaaagtagttctagaacataagtgatttggcaaactcagacatgatcctcgctctagaaatgcttacaatcttttggggaagatgaaagaaacaaaatctagatttaatatgaatatattatattcgatattaactaaatacacagaaattataaatcgacatagtccattctgggaatagcaagcatgaaaactttcctttgtttaagaaacagttatcaggtaaaagattttgagttgagtttcttctgtgtagacattgggacagtaacaaggaaaaaaaagacctctgtgcacattggaaaaaaaaaaaagatgtgtctcagagcataaatagctctgaggatgcaaagcctggccagctgagtgccagctagattccagcttccacatgtccccttgcaacatatgcagcagctctcagggatcctgctcttgagaagcacacatgtagtaaatgagttaggacaagtactgtacatatattcttacaattcaaagtagaaagatgaaaggtggttaacagaggtatggataaaacacggacacagttcaggggaaagagaaatttgagtcattgtctctataactgcatatgaaaaaaaatccagttgcccaggtgttgtgattttagtgtagtgattcatttatcagtccatctcttcccatcatctaggtttgctatttgcctggaatcgcagcaccatgctgcttagctgatggagggaatctgtgaacatatttcaaaacgatcacttgaggtcacacatgacctgctttaagtttgtgttagcagggagtgacttgagtaaatctttcctctgcgacttataaataggctttcctgtaatcaaggcagagaaaatttaattaaaatgaattctcctgtggcttttccaaagcttttgttttgtgtgggcaataaagcaatgtataggcagaacatcttgaactagggtacatttttcacgtcatggctgcattaccctgttctgtgctccttggcaaaggtttgtcttcatcttatgaacctgtgttgacaggcttaaatgcttttagaaatgagctcggtggaatatttctgggaatctgtggctttttaacctaacagttatgtaagaaaaaaggggatacatcatttggaagtactggaactagtgacagtagcatacttaatcaatttaacaaatcagctttattagaatgaagcgtgtgagggttggacgtggtcttagagacaatataatccatttaccactcaatacagatgtttcttatactctctgaaacatgactatctcatggctaattgaatattttagtgatagaggaagcgtactattttgcaaggcaaccattttttttagcaagtactttttgaccttcatttttctcattcattcatttccattcttctcagaacaaaatgaaataagcttttaaaaaaaccccatctgtatcctatcttatttttctcccttctttccttcccgtttttccttccttcctttcctcctcacctccctcccttccttatttttttcttcactttcttaatctctccattgcaaatggtttcccaacttttctctgttttgttttgccaggaattttctagtttattgttgctcaaaatatgctactatgaaatgatcatcttagagatgactacaatgctgttgatgtggtcttttttttttattatactttaagttttagggtacatgtgcacattgtgcaggttagttacatatgtatacatgtgccatgctggtgcactgcacccactaactcgtcatctagcattaggtatatctcccaatgctatccctcccctctcccccaccccaccacagtccccagaatgtgatattccccttcctgtgtccatgtgatctcattgttcaattcccacctatgagtgagaatatgtggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcatttttggacatttgggttggttccaagtctttgctattgtgaataatgccgcaataaacatacgtgtgcatgtgtctttatagcagcaagatttatagtcctttgggtatatacccagtaatgggatagctgggtcaaatggtatttctagttctagatccctgaggaattgccacactgacttccacaatggttgaactagtttacagtcccaccaacagtgtaaaagtgttcctatttctccacgtcctctccagcacctgttgtttcctgactttttaatgatcgccattctaactggtgtgagatggtatctcattgtggttttgatttgcatttctctgatggccagtgataatgaggattttttcatgtgttttttggctgcataaatgtcttcttttgagaagtgtctgttcatgtccttcgcccactttttgatggggttgtttgtttttttcttgtgaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgctgttggtgttttggacatgaagtccttgcccatgcctatgtcctgaatggtgatgcctaggttttcttctagggtttttatggttttatgtctaatgtttaagtctttaatccatcttgaattgatttttgtataaggtgtaaggaagggatccagttacagctttctccatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggtgactgtagccttgtagtatagtttgaagtcaggtagtgtgatgcctccagctttgttcttttggcttaggattgacttggcgatgcgggctcttttttggttccatatgaactttaaagtagtttttttccaattctgtgaagaaagtcattggtagcttgctggggatggcattgaatgtgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttgatgtggtcttacttatactgagcactaagacagaatcacatttaaattttaaaatacaagctttagaaataaccatgcaaccttgttgaccaatcatgaaagaatggtcagtgaaactcctttttctgtttcttctccttccagttgctctttcattttatagatgtagaatagtccttttcattttaattgcgactcttgtcacctcacatattacctattatattattaaataatatatttctacataaagacagaatgttacttcaaaattatgcttgtttagaactttgataatgttaaagattagagagcctttaatgctaggttgctgagattgtcttttgaacctttttttgttatggaaaattagaaatgtacacataaatgcactcaaggaaatatattgtcaagtaaacattaggctttattttaaatccgtctcttctctgtggccttttgactttcctactgtgtgtttgcaagagagcaaaataatttataccagactgtttattttttataacaatgttttctgctatttcttctctttgatcttttaatatcttttttctcttgtttgctagcaactaatttttctctctgtgtataactaatagtcatttgggttattatggtgataaccactggtaaaaggtactgccggtcaaccgtaggctttcttcttgatgaatttagcagacataggctcctgattgaagcagatggtccgttgtttgtaatctctgggaaatgccaatgtgtctgtgagcaggaccatatccttaataccaactccagaattttgatcagaacagctgggtttgaattgcattgggattttcaagagcacccaggtccttcctatctaatacattagcctgttgagaagacactctaccatttgaatatggtcttttactatatctgccaagtgtggagatgatactctcagttaaggctgcctgagcaagtatcttgcagataaagggcttagtaccgtgttagaataacatgctgactctttactatcaggtatctatgttggaattgtagaaatgagagttcatttggagaattcaaaactaaacttaatttccctcaacatgttgtcattgtcatgtaacttgttttaagacatctgcactcagacaagctagaaaaatgaaagaaaagaaatttgtaccagccagcagtaacaaaaacagtagcaaattggattttggttaataaccagaggataaggtgcagttgtatagttaatccttcatggagttctgtaactttttttcatctcctttaagtctttataggtttagagaaaaaattacattgttcaaagctttttgtgtactttaaaattatcttttggtttgtgtattttttaatatcatataatgacttttttaaacaggtaaaagatttgatacagacaacagaggcgatgatgtttattgaggaagtatgtttaagccttttgcgtcatcctgttttctggaaaattcagcttacccagatgagtcttcagctgctgtgtgtcagtgaagtcagcttaaagataactggtgaatgttcatcttcaattcaccttttagagcacagtgttgaacttctgaaggaggtaaggatagtagtatattatactgttcatgcattgctattaagaaatacctgagacttggtaatttataaagaaatgaggtttaattggcttacagtctggcaggctgtacaggatgcatggtgctggcatctgcttagcttctggggaggcctcaggaaacttacaatcatggtggaaggtgaagcaggagccagcacttcacatggctggtgtaggagtgagagagaggagtggcgagatactacacgcttttaaacaaccagatctcaatcactatcacaagaacagcaccaggaggattgtgctaaaccattcatgaggaacacctttgtgatccagtcatctgcaccagaccccacttctaacattggggattacaatttgacatgagatttgggcaggggcatagatccaaaccatatcagatagacgttttattgtgtcagttatcactcaagtgagtctttcaataactgggtggatctgctcatttagtttgcatattagaggcattttgatctaataccattagcgcatattgctattgcactactggtaatatcatttattagaaaaagaaatcattaaaatactcttcggatcatcaattaaagatcaccactgtgacttttttttcatttattcatgcagaacatatagtaatatgccaggctttatagaatacatagatgaaaaggtaaattctatgacctcaagagacttacagacatgcaaataactaaattatagtacaataagagaaaggattttatgggagtatatttaaaatgtaatgggagaacaagtttcaggaggtagggcatgagttgagattcgaagactgaatggaatgtgcctggtacaagggcctgggaagggcattccagctgtagaacagcatgtgcccaaatagagagacatgaaagagtagtcaggcttggcttattcaaaaaaacaagaggatgttgggtattgttgaaggattaagctgtggcaaatagggctgggcttgtcttccatgccacacaaatgagtttacattttatcctctaggcaatgacatgctgtttgagacctttcagcagatctcattttttaatgtgtggaagatctttctcgtaggaagatggaggagggtttgggaccgcacaccactaatagggtaggaagtgaggaggatgtcttaggcaggctaccacagactgggtggcttaaccaacaaaaatgtatttattggttgggtgcagtggctctcacctgtaatcccagcactttgggaggccgaggcaggcagattatgtgaggccaggagttcgagagcagcctgaccaacatggtgaaacttcgcctctactaaaaatacaaaaaattagctgggtgtggtgttgcatgcctgtaatctactcatgatgctgaggcaggagaattgtttgaaccctggaggcagaggttgcagtgagccgagattgtgccactgcactccagcctgggcgacacagcaggactttgtctcaaaatacataaataaacaaataaaattatttctcaaagttctgaaggctggagagtccaagcacagggtgctggctgattctgttcttgatgaggactcttaatggcttgcagctggctttcctcgcatgatagggagagtatgagctctgtggtgtcttatgaggatactatccagattggattatggccccaccctgatgacctcacttaaccttaatgacttccttactccaaatacagtcacttgagggttagggctttaacaaatacattttgagaggacacagttcagcccatagtgagggcctaatgagggaaatggaagtgggaaaagggagacatagaagacagaatcagtagggctttatgattgattagatggtcaaggagaagggtccttgatagaatctcagctttctattttgggctactggatgatgccattcactttgagaaatggtagctgatgttggagggaagatgattaattagatttcagatatgcttgacttgaggtatgtatggatcatacatcgttggatatatggttttgaaatttaggctagaagtctaggctaaaggtgtacatttgtagacattaactttggggtggggattttaaacacgggactgggtgacagggcttgtggtggaactctggggtgtttgtggtggttatttggaatttactgataaagaggaatctgagaaaatatgtctagaaggatcatatataaccagcagagacagatgacaagaaaatcaagggaaggaatatctcaataagagggagtggtcagcagtgtcatgtgtcatggagcgatgatgtaaaagtaagggatggaaagtattcttaggatatagcatataaaagcttattgttaacattagaggggcagtttcagcagggtggtggtggttggggggcgtggaaattggaattaagggagtgtgaatggcaggtgaggaaatgagagagtaaatgtagattttgatggaagttgggagcccaggaagactcaagtattacaagtcatttgtcaatttgccaatcttatgattagaatgattttatatatactgggactctaaataacatgttttctattatacagttacatatgtatcttatgtgtagtagatatatatatgtataatatatcaggtataattatattttacagatataatcatgttatatataatatagatagtatataaatgcatatatagatgttttatagataaatattatacagaaagatattttatagatcagtattatgtagataaattgccagttctgttaactgtaaatgtaatatccatgggtaaaacccatatttttcctgggtacttttagtagattcatgtgagtagcaagtataatttcatacagtttagtcctttttagtataattctctgaccattttattgtgtatttccccccacctttagcatatatttattaagcagatgcctatggcaaacactttgctatggcaattagttgaaagcagacaaggttcatgaagcttatgttttagtcaaatggttcaaactagtgtgcataaaaatcactaggcagagtttgttacaaatgcacatgcctgggccttatccctaatgatattgaattagcaggtctgagtgcggcccaagtattctctattttaaagtagcacccacaggtgatttttatcatttattttgcacataaggcaaatagcacatagatcaaaacatagaactttgaaaccatcacacagctcaagaaatagaggtttctagccaccacagaagttctccacaagcccagtcctattcataacctcctttttcccctgactattcagacttctatagtaactacttccttacatttctttatagttttgtcatctcagtgtgtatctctaatcactgtaatatgttttggggtatgtgtgtgtgtgtgatcttttaagtgtctttccaattaaaggtcatcccctttcgtttcctcccccacttttcttccctgcagtttgtgtgctgaataacctggcttgtgtgagctggagagtttcctatcttctggattttgctgattgcaaccgtatggtgccctttaatacagtggtccccaatgcctgggccacagactggtattggttccttgcttgttaggaactgggccacacacaggaggtgagcagcccagtgagccagcattactgcctaaactccatctcctgtcagatcagccgatgcattagattctcacaggagcatgaaccctattgtgaactgtgcatgcgagggatctaggttgtgtgctccttataagaatctaaataatgcctgatgatctgaggtggtacagtttcatcccgaaaccattccctgccccaggtgtgtggaaaaattatcttccatgaaaccagcccctggtgcaaaaaaggctggggaccactgctttatgtgtttctctgttcaaaggtagttagctctaaaggcttgactgggttcaggatattttgttttttgtttccaagactacaggggatggtgtgttctgtcatcaagaggcacaatgtgtgttgcttttctttttatgatgttagtagttgttggtacgcaatgcctagttctattaattcattaggagttgcagagtggtaatgttctaatcctatcattccttctccatttattagctggaatacttccacaaaaagaatacccttcctccaataacctactagttggttatccagtggtaaaggaaagttagaataaatgctgtactcttttgcctttttctttatttactaactttaaaaaatattatgaattcatgaatttaaacatatttgatgcacttcagtctatcacagatattatccatattgaattttaaattgtcttattttggccactgggaatctattaataagtggctcttgaatctaatttttaaaatgtttttgattataatgtagagtcacaggatactaatgtcatttagaagaatgaaaagatttttggtgagggaaggtcctatttatgtctctcatttgcccaatgttttagcagttttagaaggaaataacaattagtagaactgttgaaatatttgtgtaatgaagttttctgtcccccatccccatcttagtgttcctgaggttaaaaaagtaagcctaggaaaattaatttgtgaacatatgctataggtctatatgtactacaatttgaaataaaatgaagtagaatgaagtagtcttatgtattttgacaccatacccacatttctgtatcgctgggtttatcagctggatgtcttgttcaaatattatattcactttttcctactctgttctctttctactcttatatcagcgttgtatcattgtacattgaaaatggatttatttcttaggctgcattagtttttgtggattcggtcttagttgagccatttttagcctgattagaataatcataacttaaggtcctttccatttcaagcaaaacagatgtaccctgaccagcaaaattaggcaaaaatgatgctcactgggaggagattgggtagctctcgaagtgaagaatgagtgaaacatttcagcattgggaagggtcggaaacttcccagcagcactactggctgatgactcagttccaaccaactttcttcactgtgtgtctcattttaagttttcagattttgtaggaaaaatgatctgtttggcccatcttggcttgatcaagctctggccaggggaacagagtacgtagcaaagttagagcactggaggattgtgtgggttgggccaccatctttgttttgtctgctaccttctcatgccttgttttctctttaaaaatacttttccatgactatactgtaaaatccttgagaaaagggactattttgtccacagtggcattcgtagacccagcatatgtccttagtgcctggtgcataggtgatgtttagtgctattttcatttgacttgaggacaaaaagtatggactccaggttgttttctgttactgggactcctccgacatctgtggctgagtataaaggcatttactcattttttgtattttatttcattttttaaaatttccttattttatatattttatttccttatttattttattgtattttatttatttattttattttcaggctctgagttagcctgagtttccctaaaggcaaaagtagagcctgggtttccacagaagcaaaggcttatatgactagagttcatctgacaatgtgatcccagcaagcagttggagagggacaaaaggagtgaagtatggaaggtgggagaggcaatacaggcatcatcaagtaggctactgctactagttgcttgatcccacagaatcttctgagaagccttatgaaagaaggatctggaattaatgggaaagcatttatctatggggtattgttgccgatttgtcagctttggcctatggggctttaacttccttgtacttctagagtgcgctattctggggcagggagcaagaggtgcatggtggagcttcaggggagaaccattaggttgcacctgtgcagagccagttaccacagcagtagctgtagcatttgaagtgtgcaaaggggatgtctgacacagggttttattaaaagatcttattaaatggtactatcctttggtgtccattaaaaatcaatcaatcaaaaaacttgtaaccactagacttgtaagcagtttaagatttatgtggtctaatcctccaccatttacttttccttatttttgatcttgaatctccacctcttttccattcaccctctattctgaacaggccagtctcacccttcctggagaaggccattttcatttttgccttcatacttttaagttccatccacttaaaaatacttctgttccatttcagaactctaaaaagctactttatgggccttgcagtaatagcttgtgtgaaaaaggctttccaataatagcattactatacagcagtgcttttctttgttgttgatcgttttggaatctagtaaatctgaggtttaagtgatcttgttggttttccttttgtttttttatggacatgcagaaattaaaatgaaatagaggaaggtatagcaaagaatggtatgatagtatatactgtaagtgtgttggtttcaaaatgcatgtattatcctcaaatagataagagttgcttcattgttttcgactgtatttcaaaacaatgaacacatatattcctaaaatacatagattggaatatatcccatttttaaaaattcacgaatttttttcttttgttgttttttttcaaaagtccataaacaagcacatgagaggattttgtaggttaatttcactcttcaaatggtaaaactgagattttagagggtatttgttagtttgatagtatcttcaagattataatttctgggtatgtcaaattatattgttttcactcaggcaggtggtcctttaacatgtggctctaacttacagatttcctttttttcctgtgggttttttttttttttttttttgactgtctttattgttcataggtacttctgctctgcaggcacttctgtaaacttcagaatagtcattttagctgaacctttcttctttagtgccataatacattaagattttctttatttagaaacctcaaataacatgtctcttgtgttttattaatatttattaaaacctaatatacacatctttttttcattttgtttatatacttggtgaacttaatggttttccatttctatggtcattgctctgctacatttaaatatgcttaatgaattacggtaattcgaaaataatctctacctccctggcactaatatttcttttattgtgacatgatttactaaaatttgtttagtgtaattcattatgcaagttatatagatgaatcatgtctgtattaggtaagcagaaaattgaactacttttcagaaatgaaatattattaaatttagtattttaggcaactttcaatggtttttaaagattgactgtttaggccgggctcggtggctcacgcctgtaatcccagcactttgggaggccgaggcgggcggatcacgaggtcaggagatcgagaccacggtgaaaccccgtctctactaaaaatacaaaaaattagccgggcgcagtggcgggcgcctgtagtcccagctactcgggaggctgaggcaggagaatggcgtgaacccggaaggcggagcttgcagtgagcggagatcgtgccacagcactcccgcctgggcgacagaacgagactccgtctcaaaaaaaaaaaaaaaaaaaaaaaagattgactgtttagaagacttgctgatctgctgtgttgagttttcctctgaattatttggtttatagcatcttgctttttggccatataatacatcattttgaatttatgtgtgactgtgtggcattgactaattctttctttttttttgagatggaatctcgctctgccacccaggctggagtgcagtggcaccatcttggctcactgcaacctccacctcctgggtcaagcaattgcctcctgagtagctgggaaattagcctggctaatttttttgtatttttttgatagagacggggtttcaccaagttggctgggctggtctcgaacttctgacctcgtgatccacctgccttggcctcccaaagtgttggcgttacaggcgtgagctgccacgcccggccgaccaattctttctttagtagagcacacttgctgtataaataaatttgtgtaataggcttgcagtctttcatattaaatatattcttcctggatacatgttacaaagccatgattctgggaacttctttaacaactcctttttccccctctattcttttaggattttcctgttgaactggtcataattggaatagctttactacttctacagactccagcaagtcagcagaagccaatcttaaatctaggtaaataaaaatacagtcactagagtaaaatgtaaatataacatgagtattgacaggattcacttgaactatgtatcctgctatcttgtgtattttgagtttccatctgtaatttttaaaattattaaatagaattttttttcttgtctaataagttgttaccttgtgcaagttttaatataacataatttaccaagtatctcggctgcatgttagaggttataatctaaccttatatggcagtaacattcaggaatatattgaatggcatagcaccttattcaacattgtacagcaaaatggaaagctttagtataaaatccttgaaagaaaagtgtttagtagttgtagttatttttaaaactctccataccttaactattcaaaatgtaaatctagctagaacaaatgaaagataatattcttttgacagtccagtattgacttaaagaaaagtgaaggagggggccaagggtggcaaaaatgttctagttaagaagaatgtggtaaagaagctagttgccctatcgggcaaataagtcatacttttaaaatgtggcttttacattggtgctgcctcactttacttggtctgatccaaaataatccacataacaatgagagctctaaattatgttgtatagtgccatgatatgttgatatgctgctgttcttagttttaaaaagtacgtgagaggccaggcacggtggctcatgcttgtaatcccaacgctttgggaggccgaagtgggtggaccacctgaggtcaggagttcgagaccaagcctgggtaatatggtgaaaccctgtttctactaaaaatacaaaaaaattagccaggcgtggtggcgcatgcctgtaatcctagctacttggttggctgaggcaggataatcacctgaaccccggaggcagaggttgtagtgagccgagatcgcgccattgcactccagcttgggcaacaagagcgaaactccgtctcaaaaaaaaaaaaaagtgtgcgagataaatacttattgtatagctcattcttctgggcattttaattcatgattttgggagtgaattgctctttcacctacagtgtgccttggaaatggctttagcacatggaggggatccttggctcctaggctttgattcctaccctgcatttggctactggctttatgttcgcttataccttccctccacagtctgatccggtttttgcctttttcttatagcagtgcacatgggatctacccaaaggtataatttacccgtgctggtacttctgacagcaatagttttcttttttaaaacagctttattgaggtgtaatttacataccataaaattcagaataaagtgttttctagtaaatttatagatttgtgcaaccagcaccactgtctatcatctgcccaaaatttcttgtgatcatttgtagttaatcctcattttcaccctcagctccagagaaatactaatctgctttttgtctctgtagatttgccttttctagacatttcatatgattggattttgttttctgacaaaaaaattctaaagcctcagaaaatccacatttcaaattctgaagctatgttcttatattgtggttcatgtgtaagagaaagataatacagtatcaaacagtcaaatacttttattatttcctggttagcagactttttctttctctcgtaaaccaatatctctgatttgaagttaccttagagtgaataaactgtactgaacactgctaagccaatatatcatgttggaaagtaaggaagaactgtggggaaagagtattcaaagaaataggataaccaagagaatattgattattccaaatttaaaagatttatttatacattaatttttatattaatgtaatattacactatgtagttgttaactgtagccttgattacaaatagcaatttataaaaatgcctggaatatttagatttataatttaggctattaaaatactgctattatattcatttcctgttatattaaagataatggattttcataatatctcagaaacaattatggattaagaccaatatttaggcaagaaaagtaaattagtagtgttagagtaacaggtgtttgtacttaatatcatgttaaggtttgacctccagatgatgtaaaatagaatgctgacaactcattgacatgattcaaggcttgtagaatttttgctgtagtggggaaatcagttgaatattttgataatttaacgttgaatcccctgaataacatcttttagtaaatcagggttaattacatcactttgaaaaaaatattgtgaaaaaagtatatttatgccttaactcattcagttaatagtctagagactctacatgtaaatcagttattgtataactgtatgtatctggtgtgtaagttgtttccatgttaaagaaccattcactaattttttttgttgttgttattttggttctggactttgggactttcacaatctgcttcttagcaattacagctgaagggcagtcctgcttcactttgctgtttacttaagcatctgctaataggattcttagctgcctttgtaaaggaagcatgtatgttgggcttgttagccactgatccaggaattcttggtctcttagctctgtttgctgagggcaatactagcatctcagaggatattaagggcaaatgttgaattgtattttttaaaaaattcatattaacctaaaagagtatcatcaatttttcagttatatatgttaacagcttattttatataatagtttatttatactccttttatttccttttaggataagatttatcaacctagttatgtgtctgacccagttataaaagggaagaaaactttcttgcatatcattcttaagcaaaattgcattttgtttgactgtggtattaatttttaaaaatgtgcattattgttttgatgaatagctttgaagctcctctctgttactgaggatcagaaaatcccaaagtcctctctgctgctagtgatgccaattctgcagatactatcttctactgccttggaagactgtatatctgtggatgaagaaggtccctctaggcagcagttggctctaaaccttttggaaatgatacagcaggaatgttacagagatgaccaccaaaaggtaatgaatctatccttgtttctcttaaataaagtgtcgatgtgggatttcggtctttacggataatcttgcctcctgatgaagcatctgtttgttatcagacttcaccattcagtcaggtagtgctgttggagatctcaacatattcttctggactataagaagggatagtagtcctgttgtgaaataagtttgaaaatgctatatgatcttttttttctctgaaaatccagtgcacaatactagttaaagatcctgaagagttcttcagaaaaggaactaatgcttctcaaatatatttgaacatggaatcattttttaaaattatactgttagttaagtacagcatattgctagatctgagataatccaaggtgggaaatagtcctcaaatgcctggaagttctcatatcagtaagaactaaaacttctttatttaatatggcacctcttgccgtgttccctggcataatggctctcgatgtcccctgtgtatgcccctattctgctgcctccaactggaagacaacaggcctgccacattccgtttccaatcctgcctgcctcattccgctttttcagtcttgcttttcctgttacaataacgtgaaagtgttgtcatggtttggatattggttgggttctaggcctagatttaccagactttttttgttttgatatttgagttttgcctttatcaaaatgaaacattatttcccagctcctcttatggggatgaaatgaggattgaataagataaagctggtgaagcatcttaaatctccatgaagagaggcactatgtaaatacaaactggagtgatggttgtggcttcatctgcaaaagcagagatacctcttatgttaaatgctccagcagcacaaatccagtcattattagttcttgtttgagcatgtagcagaaactggcccataattataggcaaattgaatgtatactacagcttcctaaatcctaattgtttgactaaaactttaaaacttgaaacaggtaatcgatttgaattgagagagaagttcttgcatcagccctaataggagtacaaaatccgatcaaaaaattctagtagcttttttactttacctcttggtttgcccatgtagaacaatgattggatcttgaatgggagtgggggcagggcaagagttggcagggcaagagttctgctcctttaaatcacaagtgttatttactgaggatcaccccaactctaatacataagtacttggtttactatttgctcagatgtgtgtgaatcttattattaacactaatatctggactttctctttagcagctggtaaagaggaggggcagaattactattagggctgtaaatatcctccttatgatactgtgttgctttaaggaggctttgagtagatatatgatcactgttttaaaaaatgtaagccacattttactgttggcttttttttttcctgcacctatctggaactttacattccagtcacacctatgaatttaacatgccccaaactcttcaagtctcttcctgaatctttgcttctgcacagaatgctgttttatgtcagctgcctgaactattcatccttcaagactcagccaaatgttctcagcctccctgagtcaagattatttgactattggatttttttttttttttgagacggagtctcactctgccacctaggctggagtgcagcggtgtgatcttggctattaaatgtgatatttaaaactacctatttcattctccccaggcaaaataaataaataaatattaaaaaaagtaaaaaaaattgaacactaattgtaaattctaaagggcttgaaacattctgcttcctccttgttctcctccactcccgcaagagaatgtgggggataaaagagagaatgcattcagtatatgagtcagattccagtcaggaaagagaaaacacactggcaatttgaacaaggaaaacttaatgcaatgaattattagcaagaggtgtttagttataaaaccttataaaaaagcatctaaggaatattacagtagtaaatgtagggagcagctactacctctaagctaagaccaaggcagagttcccaaggaaggaactaaaaagtctccccagacaatgctgagagtcagacctggtaggagagaatgtggagaaggcctactggatgatatagtctgctggggtgccataggctagaactggtccacaggaaaccacttgtcgtgtgagcaggctggaattggctgagctggtccactggaagccacctctgggatatcctgtatgtccctagcagccatggtaggaggaatcaaagaagcacacaggaacctgaagagaagccccttcttcctttccttgcagtgtctctcctatgctctctattgacaaggtctaacactagaccagagggcaaaggagaaatgttgaaaaggcacagctgtaggatcacatagtcaggcaaagaagagtgggtgtggagctgagaggtaacacattgagtaactggctcaggaagtaagaaagaatcggaaaagtttttttggaggggagtaagggtggatgggtgagatgaagtggaaaaggagacttaaaagctaaattcttgtaattgtacaggagggcaaaattcatctttatgaaactgttttagtcagcataacaatttagagacagcttgactgagctggggtctaccatgtgtttattcattcttatgtgtttttaaaaattaaatatggtacttttgggtctttggtaataaagctgtgccaagtagattttatttgaaattgctttgaagtagtatatagtaagcagaatatttgtttcttaaaaatcagaaaattcgcaaggaattgtcattgtcctacttatggctaaagttaacatttattgaacatgtgtgatatgccaggagttattatgtgggccaactcgtatttcttacaataactatgaaatagatgtcttttctttctttctttttttttttaatctatttccagctgtgtggccttggactagtgactgaatctgtgtggtatctgggccctggtaaaatgggcaacaaaacacccccttcatggggtggtttattgagcatttcatatgtgcaggcttcattttaagtactttggtatatattaactggtttgattttatctcacactctttgaagtaggtaaaattattgatctcattttacctaagagttaactgaggcataaagaaggtaaataacttactgtcatgcagtgggaacccaattcttttttaatagctttattgaaatgtaattcacatgcgcccttccctcatttaaagcatgcaattcagtggcttttagtatattcgcagcattgtatattcattaccacaatccactttagaacatttttatttttattaccctaaacaatccctgcactcttagtcatcactccctaattccccccttttttcctcacccctcaggctaggcagtccctaatctgcttgtagtctctatatggatttgcctattctagacatttccttcaagtataatcatacaatatgtggtcctttgtgactggcttttttcacttagtataatgttttcaaggtttgtccatgttgtagcatgtgccatgtagcagtgcctcattttctcttagagctgactaatattccattgtatggataccttacattttactttccttttcttttgttgacgaacttttggctctttcccactttttggctataatgctgctataatcattcatgtatcagtttttgtgtggacaaatgttttcatttctcttgagtagataccgaggagtacaactgctaggtaaggtgataactctatgtttcacagtttgggggaatggccagattgttttccaaaggggctgcactattctatattcccaccagcagtgtatgagggttccagtttctccctgtcctcgacaattgttgttattgtttatctttttgatggttacatcctagtaggtgtgaagtggtatttcattgtggttttgttttgcatttccctgatggtattcttaaaatacttattttacaagccgggaaactgagattagagcggttaacttttctggattacccaggtagtgaagggtagagttggaattcagattttgactgtttgattctagggcctgaatcctgttacctgcactttcattttgttttctttctttgtttttttggcacaatattttatcatctttgtgctgaacttgggcgtaaataacagttccatttcagatttacaggggaacaaactgtgataatagtaaattgaaataaactttttttagacttctgattggaacttaaaaaggaattagtaagtcttagatgttgtgcttctatcatcatcttctgaaagacatgggactgagcatgttgtgtgttatctcttggttataaccaaccactcccaaatctctcagctcttgtctagagtcttcatagtgatatagtgctagaaaggctctcttgagggtttatgtagtccagtcttctgctgcttgactgatgagtgattaatatcctctagcaaaaatctatcttacttttaaaggtctatatgtttgagttcctatatccactctacttttgttaaacctgttttagtcactattatagattagtgccattctttacagttaatgaaaatcaatattgttcacaatttctttttcagacctgttttgacaaagaagtactatcagatgtttatcttattgttactacttaatgtgtctgcacatttttattaaatgctttttaaaataaagattctcaattattttctacctgtaaaagatgtcttacaaccacccagtatttatttaaatgtatttttctgtggtttattttttattgatatataattcacataacataaaccttttatttttaaacacctacttcctcctctaaaagcaaagcttactagcattttcacaggtcctccctcaggctatggggccaggatttggtagctggtgctgagagaaaacgcttgattgcatccttgccctgggactgtgccagtggcagctgtcactcaatgggacaatttctcctgctgctctaaccttaggcaaacaaacaaacaaacaaataaacaaacaaacttaagagcctaaacctggacataacagttcaagtaacctaggattgcttttctgtttcattgtttactcttacatgtctctgttatgttgttgcttttactcaacttgaggttcatggtaatttccaaattatattcatttacataagttttatttttctctccggaagatgacagcaatactatttacctgtattttgcaacttcaggcactgtgctaggtgttttatagatattataacctaagcaggaaagtagtcatttcttaaattttacaaacgagtaaagagaggcttagaaaaattgcataatggctgatagctggcatggctatcctgaagtcctggccctttaaattttatggtgtttgtcattagtctaaaaaccttggccatggttgttaatgaatttcttcttcatgggaagaaaaatatttttagagagctagagctatataaacttagatattatttaatttttaaaatttgtaactttcttgaaatagtaatatattcaaatggttcagacagtagaaaattgcatataatgaatgcagccttcttgcctttgattccagctgtccaattttcactccccaaaacagaagatgatttagtggttactaatttcttctgtatttgtccacatacttttctttgcatgtacaagcaactacaaatatattatctttttctcctcactctctttgaaaaaaaaaattggtagcactcgagtcatactatctgtatcttatattttcacttgggggaatctttttatatcaatacagtgagagcttcctcatttgtttttactgtgacatttaattgtcaaagaaattgcatatctactcttaggtatatactcaagaaaactgaacacttataacctcagaaaaaatttataggagtgttcatagcatcattattcattatcgccaaaatgtggaaacaacccaaatatccatccattgatagtggataaacaatatagtgtatccatacaatggaatattatttggcaataaaaagaaatgaattattgatagaagtaacaacatggatgaaccttgaaatcatgctaagtgaaagaagctggtcacaaaggaccacatattatgtgtttcctattatatgaaatgaccagtatggaaccagagtagattagttgttgccaagggctggaggagggttgggggagtaaggagtgactatcagtgggtatgggatttttgtttgggttgatgaaaatgttctaaaattagatagtgatgatggttgcacagctctaggaatgaattactaaaatccagtaagttataaactttaaaagggtgccttttatagtatgcaaattatatcttaataaagctgttatttaaaaatttgataaagcttaacttttactttccatcctttcaattgttatcctaattcatataagtcagcctctattaaccagacagttataatccagagatttccagtctgtcacaaagcactatacatgatttgagttactttattagcaagcaatgtctaatgattctttaacgtctgccacttctgagctgtttatttacagagctcaccttggctaccctctggccccgactgcactgctttatttctgtgaggagccatttctcagattaatttagcataatataatctctgggtattgtttcagcttagagctgtcaggccatttcctattgcagaagttacaattattaatgaattcccaggctccagctgaaccaactttgttcctatcaacatactgtctgttacagaaatgaattgtcctcagtccaagtctgccatctgccccagactgcttctgcctagggcctggagctgggcaaatacagtattttttttttttaatctttcttctcattggtgaatacttttttagtgataatggctttttccaaatgcaattgcctctggattttgtatattgatccatatattctgccttaatggggaatgaatggtaaatatgaggaaaagttgtgataaaactcttctggagttccatctaacaactcttttctctttgtgtaatcctattacctcaaatatgtgcagagaggattttggcagtaattcaatttgtattcattttgttggaaggagtgatatcttacaatgaaatataagaatgccagaaacatatttctgacaaatatatttatctcacttatttatgcctctcttgtctttatttttcagctctcctacaagcttgtgtgccctgtaaccagtatgtatggtacaatatttacagcctggaggattcttgaagtaatgacagactcgtctgctgcaagtgactggttggcttcagtagagtcattgcttcctattactgctgtgatccctgcgcctgcctttcttctgctggctcacctccttgttgaagacaaaggacaaaatcttcaccaaatactcaaggtcactacagaattagcccaagcagattcctcccaggtaaagcaagagaataatggaacaataatgagaggaaagcttaatcattggaaatgtagattattcctgctttgtggattatttgcatcagagttttaaattatgggttgatgattttttttttttttgctatctttatccttccatttttttcttctttttccttactctgagttgatgtatacttaatgatgcaaacagtttttaaatgaaagcacacttcacaacgaaatctgcacatggtgctattctggttcttccaattttttggtggatttgctattttgtaatgcttttgctaactcttggaacctattccaagatacatatccattagttctaatgttgatcatttaaagtggacacagattaatcaattcaggataagggagcctatacaatagacattaatatctttttaacttcttgcagtttgatactatctttattgagtcatttaatagctaaaaaatattgactctttgctatatatggtacggatctgcatgctaggatatgagggtaaacaatttttcttcctaactgcacagaacttaggatgtaatgagaaagcagtcaggcattaataagacttctttccccagccttttacactaaccacatatttagcataataacctgtgactttttttttctccaattgatagaatctctagaatgcatttcctataaaggaaaggttttctaatcaagtagttttgacatttttgttatcctctctttattagtatctgtgcttgtgtttcttttcaagaatgatgaagaaaccttccatctcccaatggaaaagtgatgtgttcctagaggaaaaaatttgatggtagaaaacgggcaaatgtgtttatctgagatatgaagttaactgagtgcagtgacttacgcctgtaatcccagcactttggaaggctgaggtgggcagatcacttgaggtcaagagttcgagaccagcctggccaacatggcgaaaccttgtttctactaaaattcaaaaattagtcgggtgcagtgacatgcacctgtaatcccagctgctcaggaggctgaggcaagagaattacttgaacccaggaggtggaggttgcagtgagccgagattgcgccactgcacttcagcctgggactctgtctcaaaagcaaaaaacaaaaacaaaaaaacaaaacagatatgaagttaatgtatttggaattcctttttaacctcaaattgtcatactcattcctttttgtcatgtaaacaactgctgatatctcacaaagagttttcactctgactggacctcatctgttctgattctgcaagtggatctgtaatgtactcaaaatacttttgtttcatggtgtatgcgtaatgtgaatcagtttaacttgctttctgctttatctctccttttatttcctgtagtgatcctgcttctaaccaatgttttctttcagtgttgacacttggtaggataatctctagaatagttaatgcagataatgcctggagattatctaaagaaggattcccttgaagttatacagtgggttaccttgatctgtctacaccactgacagaaaacatatattgcatctatatatatatgcatgcacacacacacacacactcacacacacacacacacacacacacaggaaatttgatccagcatgatgctttagattgtaagtaacagaaacccatcttaagctgccacaaagttttttcccctttatttttagttcccaattaataattgtacatacttatgggatacagagtgatattttgatacaggtataaaatgtgcaatgatcaaatcagggtaattaatagtatatccatcacctcaaacatttatcatttttgtgtgtgcatgttgggaacattcaaaatcctttcttctagtttttattacctctagtatttagaacattcatggtctgggcagtattttcaaggtacagtttctttcctctgtgaattagctggaagcccaaagccttataaccttatattcaaaattcaaaaggaagagagaagtaaagaatgctcagattggccttgcttaggtcatgtgtttacattggactaaccatcatgatgggataatggggcactttacttggccatcctgggtagaatagaagtaggtgaagtatcaggtctaaaattgtttctgccaccaggttcatgtggaatggggtgagatggtcccccaaaggaaggatagatagtgtactcatcatagaagtggaaatgtgcaaaataggcaaaaaatgtaaagcagaacttctcagtttgtcttttgggggacactgaaatgctgtatatgtggtaggtgtgccgagatattatcctgtctcagcattctggcagccagttagttgtcttagctcaggctgcctgaagtctctgtctggtagcctctggccacctggtatgtagaagccttataggatgcttaacagtatcttataaatatttgtagagggaatacctaacaaaagattttattgttttggaaatcaaggctacttgtttgtggttttaagacctgagaaaatgtgttttcctcctatgtttctatccataaggtttaagggtttatggtaagattaaatacttaggtatctgaactgaacatcaaccacaaagatgagtaattttgagataggttgagttggtctaaaataaaagtgtaaatagtttaatatctcaccttcaatggaataactctaaatactatgtgtaaggtgtatcaatttctttttgactgatttataaaatagaatatgccaaagagcaaaaactcataaatttgattttagagaaccacaagttccttcctcaaaacgtatccccattgatgagtttgacaaattgagttttgcaaaactcagtgcctctttcaaattcttgttacttgcttttctcttgtttggaagtggcagtagagtcatgcttatttgttttgcttttcttttacttgcatcttacaacactgaggtattttattttctttttacattttggttgttaagtctagttaaaggtcttgcttaataggaacagttgcaatcttcgattattttattctttgtgatgttttcagagcttcaatttttttccatgtgtaaaagtgtacacatttgatccatttgaaatcacttatgtgactaggttcatgggccatgacttgctggtctttaaaaagtcatatattatcaaatgtaaaagttgagttatagggcagaaccctgtgatagttctacccagggtcaaaagccatattttaacatggaaaatgaataggaaatgtgtgaaatttaatggtctgtaagttactgctgtgagaaaaagagaaaatatattctataaaagaacttgcacaaagagtctttggacactttgtactctgttctgttgttaccgaattctatgaattgctaccccctgaagtcagtcggctacctgtattcttcacaccagcaaaaagaagccagaatgtacagtacttttaataaatagcttgatagataagaagtagtgtactactattccctggtaaccatagcatcgattatgcctggataaaaattgggatgagcctgccagcatgaagcaattaggcaaagagaagcacaactgaaatataaggtcaagttgcatgtaccctctcccgtggcaatatgtttatttctcctttgtaaaccttacatatatatctgtaggataaaaagctttcagctggcatttgatcccttttgtgttttcccggttgtgtgcaaaaagcctagagtttatacacagggaagtagttctgtgttaatttcttggcattcctgggcgttagtgttgggctgttacttctgattggtctacagattagaaattactgatggttctcattgaaggaattgtaacttttcagttcaacccctaccactgtgatgcttactaatgtactgaaacaaaatccgtttgtctgggtgtgtcattgaacagcaagcatcagaaaggatggagtggagtttgaggagaaggagtccaaaactgcattcagaacagtggagtctatctgcttccaactgatatcagggaccagtaggtttgcttctggttagaactctctaagtgatgggcttctagtgttgttgaagggctgtgagaggggaatcagagcaggctttgtggtaactttgaatttcataataggtaggaggaattttgctcaagggaaaatacgttgaagtctaccattgccagaacaaaatttttcttatttagtggagagggaagggcgaagtggggatcggtcctctccatacttgtaccgtggccagacaacctgaagtggagcagtaagttgacatgtctcatcattcttcagcccttccacagtcagcccttcaaatcaaaggccagtcttatttgaggaaacatttatttatgtctcttgaattaaaccatgccagctccctgcaaccaacttggccttgatttataaatataaatgaacagttaaggctcaccagacttaagagaaaatttaacaatgtaactaaccagagcatctgtctctagaagtaacagaacttagagagcaggaggtaatgtcctaagagatgttggaaagacactgtatatatgttttgtattgtgtataaaaatcctaccaagagaaagaagaaatttgaaagcaagagatttgagaaattaaaaatgtgattgccatagtgtatatatggagattagattagtgatttgtaaaatattcatctaaatatttcataatatagagcaaaaagatgaaattgaaaaagtgaagacattgagggtcaccttggtgttctaacaactttctaataggaattccagggtgaaagaaacagagaaaatgaaggatggaaacttaaaacacaccagaaaactctttccctgagctgaaagagaacacaaggctacagattgttaggaccgtctgaaagctaagcagcacaaatgataatttatcaataccataatatgtttccagaacctcaaggatgaagggaaaattgtaagggatttcagagaagaacaggaaaagaaaaaattacttaaaattatattgaccttagatttctcattaatagcacactgggtattggaataccattggtggattatcttccagtttcttgaaaaaaactaattttgaacctggcatatttcttcccattattctgtcttttgtgagtaatggcaataaagccctttttagatttgtgagaatttgataatgtttcaatatttcaataatttttttcttactctcaagaatatattcatacaaaattgaaaacgaatctaagcaaacagagaagaaatattgaatgatatcaaaatatccagaaaattttattagtaatgttaaataattgtttatgtaaaatataaaataggataactccctggacctaaaatcctagctaattaaaacatggaaagtgggtgggggtgaatagttgtaatatgatagtgtgaagagtgagaacatgatagagtgttttttggcaactgagtagttctagatgttgataggaaaataagcttaaatcttaccttattagtaacaatcagtcttctaaaatttccaaataatataacaaaaggaaaataaatgtttaaaaatgacgaatattgcataaaataagattttaggagctagttcaggtattcctgttaccacaattactgtgaatgaattacattcccttatcacagaaaggctcgtattgagtttaaaaaattcacttgtgtactgttttcaagagacagacctgaaattgaaaattaaatgatgaaaacaaaaagctagataaataattaagaagacacagcatgttttgggccgggcacgctggctcatgcctgtaatcccagcactttgggaggccgaggtgggcggatcacgaggtcaggagattgagaccatcctggctacacggtgaaaccccgtctctactaaaaatacaaaaacttagtcgggcgtggtggcgggtgcctgtagtcccagctactcgggagtctgaggcaggagaatggcgtgaacctgggaggcagagcttacagtgagctgagatcgcaccactgcactccaggctgggggacagagcaagactctgtctcgaaaaaaaaaaaaaaaaaaaaaaagacacagcatgttttatttatttatttatttattttttgttatactttaagttttagggttcatgtgcacaacgtatacaggtgccatattggtgtgctgtccccaataacgcgtcatttaacattaggtatatctcctaatgctatccctcccccctgcccccaccccacaacaggccccggtgtgtgatgttccccttcctgtgtccatgtgttctcattgttcaattcccacctatgagtgagaacatgcggtgtttggttttttgttcttgcgatagtttgctgagaatgatggtttccagcttcatccatgtccctacaaaggacatgaactcataattttttatggctgcatagtattccatggtatatatgtgccacattttcttaatccagtccaccgttgttggacatttgggttggttccaagtctttgctgttgtaaatagtgccacaataaacatacgtgtgcatgtgtctttatagcagcatgatttataaaccttcgggtatatacccagtaatgggattgctgggtcaaatggtatttctagttctagctccctgaggaatcagcacactgacttccacaatggttgaactagtttacagtcccaccaacagtgtaaaagtgttcctgtttctccacatcctctccagcacctgttgtttcctgactttttaatgatcgccattctaaccagtgtgagatggtatcttattgtggttttgatttgcatttctctgatggccagtgatgatgagcattttttcatgtgtcttttggctgcataaatgtcttcttttgagaagtgtctgttcatatcctttgcccactttttgatggggttgtttgtttttttcttgtaaatttatttgagttctttgtagattctgggtattagccctttgtcagatgagtagattgcaaaatttttctcccattctgtaggttgcctgttcactctgatggtagtttcttttgctgtgcagaagctctttagttcaattagatcccatttgtcaattttggcttttgttgccattgcttttggtgttttagacatgaagtccttgcccatacctatgtactgaatggtattgcctaggttttcttctagggtttttatggttttaggtctaacatttaagtctttaatccatctagaattaatttttgtataaggtataaggaagggatccagtttcagctttctccgtatggctagccagttttcccaccatcatttattaaatagggaatctttaacccatttcttgttttttgtgaggtctgtcaaagaccagatagttgtagatgtgtggcattatttctgagggctctgttctgttccattggtctgtatctctgttttggtaccagtaccatgctgtttgggtgactgtagccttgtagtctagtttgaagtcaggtagcatgatgcctccagctttgttgttttggcttaggattgacttggcaatgtgggctcctttttggttccgtatgaactttaaagtagttttttccaattctgtgaagaaagtcattggtagcttgatgaggatggcattcaatctataaattaccttgggcagtatggccattttcacgatattgattcttcctacccatgagcatggaatgtttttccatttgtttgtatcctcttttatttccttgagcagtggtttgtagttctccttgaagaggtccttcacatcccttgtaagttggattcctaggtattttattctctttgaagcaattatgaatgggaattcactcatgatttggctctctgtttgttattgatgtataagaatgcttgtgatttttgcattgattttgcaaaatcattgcaaaatcaaaatgcattgattttgtaccctgagactttgctgaagttgcttatcagcttaagcagattttgggctgagacgatggggttttctagatatacaatcatgccatctgcaaacagggaccatttgacttcctcttttcctaattgaataccctttatttccttcttctgcctgattgccctggccagaacttccaacactatgtcgaatgggagtggtgagagagggtatccttgtcttgtgccggttttcaaagggaatgcttccagtttttgcccattcagtatgatattggctgtgggtttgtcatagatagctcttatcatttttagatatgtcccatgaatacctaatttattgagagtttttagcatgaagcattgttgaattttgtcaaaggccttttctgcatctattgagataatcatgtggtttttgtctttggttctgtttatatgctggattacatttattgatttgcgtatgttgaaccagccttgcatcctagggatgaagcccacttgatcatggtggttaagctttttgatgcgctgctggatttggtttgccagtattttattgaatatttttgcatggatgttcatcagggatattggtctaaaattctcttttttggttgtgtctctgccaggctttggtatcaggatgatgctggcctcataaaatgagttagggaggattccctctttttctattgattggaatagtttcagaaggaatggtactagctcctccttgtacctctggtagaattcggctgtgaatgcatctggtcctggactttttttggttggtaagctattaattatttcctcaatttcagagcctgttattggtctattcagagattcaacttcttcctggtttagtcttgggaggatgtatgtgtcgaggaatttatccatttcttctagattttctagtttatttgcttagaggtgtttatagtattctctgatggtagtttgtatctctgtggggtcggtggtgatatcccctttatcattttttattgcatctatttgattcttctctcttttcttctttattaatcttgctagtggtctatcagttttgttgatcttttcaaaaaatctgctcctggattcattgatttttttgaagggttttttgtgtctctatttccttcagttctgctctgatcttagttatttcttgcctttgctagcttttgaatgtgtttgctcttgcttctctagttcttttaattgtgatattagggtgtcaattttagatctttcctgctttctcttgtggacatttattgctataaatttccctgtacacactgctttgaatgtgtcccagagattctggtatgctgtgtctttgttctcattggtttcaaagaatatctttatttctgccttcatttgttatgtacccagtagtcctttaggagcaggtcattcagtttccatgtagttgagcggttttgagtgagtttcttaatcccgagttccagtttgattgcactgtggtctgagcgacagtttgttataatttgtgttcttttacatttgctgaggagtgctttacttccaagtatgtggtcaattttggaataggtgtggtgtggtgctgaaaagaatgtatattctgttgatttggggtggagatttctgtagatgtctattaggtctgcttggtgcagagctgagttcaattcctggatacccttgttaactttttgtctcgttgatctgtctaatgttgacagtggggtgttaaagtctcccattattattgtgtgggagtctaagtctctttctaggtctctaaggtcctgctttatgaatctgggcgctcctgtattgggtgcatatatatttaggatagtcagctcttcttattgaattgatccctttaccattatgtaatggccttctttgtctgttttgatctttgttggtttaaagtctgttttatccaagactaggattacaacccctgcctttttttgttttccatttgcttggtagatcttcctccatccctttattttgagcctatgtttgtctgtgcatgtgagatgggtttcctgagtacagcacactgatggttcttgactctttatccaatttgccactctgtgtcttttaattggagcatttagcccatttacatttaaggttaatattgttatgtgtgaatttgatcctgtcattatgatgttagctggttattttgctcgttagttgatgcagtttcttcctagcctcaatgatctttacaatttggcatgtttttgcagtggctggtaccagttgttccttttcatgtttagtgcttcctttaggaggccttttaggacaggcctggtggtgacaaaatctctcagcatttgcttgtctgtaaaggattttatttctcctttacttatgaagcttaatttggctggatatgaaattctgggttcaaaattcttttctttaaaattgttaaatattggctcccactctcttctggcttgtagagtttctgctgagagatcagctgttagtctgatgggcttccctttgtgggtatcccgacctttctctctggcttcccttaacattttttccttcatttcaactttggtgaatctgacaattatgtgtcttggagttgctcttctcgaggagtatctttgtggcattctctgtgtttcctgaatttgaatgttggcctgccttgctagaatggggaagttctcctggatgatatcctgctgagtgttttccaacttggttccattctccccatcactttcaggtacaccaatcagatgtaaatttggtcttttcacatagtcccatatttcttggaggctttgtttgtttcttttcactcttttttctctaaatttctcttctcgcttcatttcattcatttgatcttccatcactgataccctttcttccagttgatcgaatcggctactgaggcttgtgcattcgtcaaatagttctcgtgccgtggttttcagctccatcaggtcctttaaggacttctctgctttggttattctggttagccattcgtctaattttttttcaaggtttttaacttctttgccatgggttcagacttcctcctttagctcggagaagtttgatgttctgaagccttcttctctcaacttgtcaaagtcattctccatccagctttgttctgttgctggtgaggagctgcattcctttggaggaggagaggcgctctgatttttagaattttcagtttttctgctctgttttttccccatctttgtggttttatctacgttaggtctttgatgatggtgaagtacagatggggttttggtgtggatgtcctttctgtttgttagttttccttctaacagtcagtaccctcaacttcaggtgcgttggagtttgccggaggtccactccagaccctgtttgcctgggtatcagcagcggaggctgcagaacagcgaatattggtgaacagttaatgtgacacagcatgttttaatatattcatctaagctagataatatagaatacaaagtgaaaagcgttacatgggataaagagggggttttataatgattaagtcaaatttacaagcaatgccgttgaaattaggaatgacagaattctgtctgatatcagttttggccattatcagttcaagaaagaaataaaattatgtgtgtaattagggctggtctcgaaaccatgatctcaagtgatccacctgccttggcctcccaaagtgctgggattgcaggcgtgagccactgcgcccaccctggaatatacattttaattgtaatttaggatacaaatacagttattgaggcactcataatgcatagggaagagaggctataccttgtaaaaagtcataataggggccattttttattttatacttgacatctatatgatcttccttgagtatcatttttgagcaaagaatggagtaaaatacatatctggatgtgctgtattagttctttactttgtgaaccatagtttcagtagcagtacttttctattgtatttcagatttaattttcttgttggggtgtcaaagaaaggcagtcacacacagtcacaattatgctgctacgtgatagctgtaattgaaatgatgggttatgatttggtggatttggtgggaaaagtcaaccccagaatgcctcaagttggacacctgtgttaactcctttaccagaagtgtcgagtgcagtccctttgtctgttgagcacacagtgcttctacctgaccaatgacaattttgagcttttcacgatagttgttataatagactcttaggcaagttttcaggacagttaatgtaatgaagttgggcactcagccgttaatgtatttcaaatgggtagacatggctacaaactaagtggagccaggcaggtagttaagaagtgatttgggatgatttctacctggcaggcttatggtatattgattggacttttggaagctgtgtcctgtcattcttgcttgttaccatttttttgtgagaatggattacttctacattgaaaacaatttgtgtgtttttccttttgtctctaaagaaaacaagcatgtaaatatatatatatatgacttgaattttattatattggagaatcaaatagcagtaaagctaaataagagaagtaaggacaaagtgtctttacacttccttttgaagtgtcctatagttatcttgaatgtaagctgtcttcaaagggaatttttagtagatacaattagatttagaattcatgaaaggaatttctcaagggaaaccatgtcttacttgtttttacctcctagtaaccttggacagttcttgggctttggtatgtgtgttgttgactcaattaacacataaatatattaggtgtatctaccttatgtcctagaacaaatagactattttccaatattgtcatatgttattcagactaatagatgaaacactgtagagtccagggacagggtttaggttaggttagattgcagtaaaatttcattaaatgaaatcctattaatttagagctcaggttaatttgatataggcggaattaaaacataagcaggtgttgaagctactgtttttaggcagtttgaatttgctcatttgctttagcacaatgaatgtggtgatttcaaatggtcgaattatctgttcattaacatatcagcagggactggtacttggtaacacttggctaattagtttgttacagtatatatgtgaaagtaatagaattttatttctttaacatttttctctaattccgtattgcctcctttcattatttccagtagtgtgaattattattaataataattatcctggtgacattttactttatatgtatttagtgtcagattgtgttaaatttttaatgttagaggtgcagcttgatctgcattaagtggacttatcatggaattatcattcagcttgaaatactatagatgccttgtttttaggaaatgagaggataggtgaaaagaagagggaggattgctggggaaagttgctagagggttatgagtgccaccagtggcagctccttatctcaagcctagtgactgggacttcagcctaccttctacctgccccatgtctctctctccccagtccagcttaatgtgtatcccccttgtagttggggtggacaaatggatacagtgaattggtgactccctgaaaaattgaaaagggagtaatggtctgcttagttgttttgatagtggaagtgaaggagagagtactgcagtatagggattggcttatatggctagaatttgttgaagtaaaagatgtgttagtgttccctttgacagaacatagggaacatgggcaagagaactctaggggaattgtttcaaatctcttatgatagggctgcttagaggagtgtacaggactctattgaaagaagcaggattcctaagggttgtggtctgttctgttagagagtatctcacctgcatcaagagtctaaagagaacttaatcttgcagacttgggctccttgctatggagcagtaggttaatccccttgggacctgttcgaggtgaagacaccctaactcagtgttgaaggagtgctgacattgctccctatggtgagcagattcagagatggaagtggtgtggagaagtcaagcctagcagcatcaattaaaggttgtaaggttaaggggacccctgagaattctgtcagttaactttgtggccctttgccacagagattctgaatttaaccttcctaatctcctcagtgtgggagtaagacatgtggagataatctcaagtttaggcttcagtgggcattgattgataatgccgaaccattttctgtagtagagattgccagaaggtgggttcgattcacaccttttcctttggtttccactttaaattttttttgtgtgttcctgaggtttacaagtagaagtctcaaaattcactttagcttaagctttccttggtgacatcatattgtctttaccattaatgataaattgatgaaatatcatgaagcaaaaaagtatttgctataatcaagtatgcccattctgttccttttcatgtttttcccctttgagacaacagtggaatttcactagcttgatagagaatttttggtgcctgttttaaagcactcagtgaacatttgatgagttcctagttactttttgaagccggggagggttcagacaatggtctgcaaaattgctgaggaaagtcctggaatcatttttaaaacagtagaaaaatgaagaatcatgcatgcatatattaggttgtcttagatcaaaccctggctgaagctatagtgacacatgctgttcatgaaagacttaatacagtccttctaatcggatgaattgtcttgttgtgcaaaaagtgttattacactgtgtgtgaaaccaaccatgcttcagggggaaaaattaaatcgcctgattgagaggtcactggtgaatagtaacacaagatctattaccgttattagagactctggaggacattcacccttttatggtctttcaactgctggaatgaaatattttagcggtaaatgacacccttccgggaaatccttctgaagattcattctttgctgcttgcatgtaggaaaaaaaaatcagtggcggggggtgggggtcacagggaaaaatcacattattcttttcagatcacttaaaaaaatttacctaatttgatttggtttgctaacaattgcccttaaatgtttcccattacacccttcttaatctgtgcctattaggaccgcactttatcttttgtaacatgtcatgcatgttctgtaatagtttccgcagggaaattcacgatagcatgaaagcccagacaccagggtggttgtggtttatgtcgaaatcaagattaagcactttaaggtacatgaagtgaaaagtctatctgcttattttgtttattttcttttaagggtctttgaatgcatgtacggaggattaggtgaatatatatttttagttctgcatggcaaccatactgaacagtaaatattttaagaaatattttcagaagtgaatgaataactattgatctgaggtgaagctttataacacagttattcaagtgggaaccagagttcctttccaatggattatattcattataagctgtcaatccatttgttatagtttaataccactctggaattttctgcctttttgctattgtgctgtatggttgggatttgtttttgtggggactaggaagaaacaaagtgatcagcaataacattgcaaataatttggataattttttttttgttaattttcaggtcaaatacctgactttctcttccttccattatttgatttcagcatctttcccccatttcttctaaagctttcttattttattgcccaaaagatatggaactgttaacagtgatgtgaataagcatataaattctgttagatttctcattgtctgcttttgttacaggtatcttgatgggttcattaaaacatatctgttgaaatgggggttgggaagacgaaggaataggggaaaggggatacgttgtcagaaagaataatacatagatatttgagcttcacctggaaataaaaataattttgtaaaataggagatagaaaccctttgtcaggttgctaatgagaggcttgacctagctgctgctgcagcagcatctttggggatgatgagagatgcaaaatgcactgttgctaggcaactctcttggctgcctttggagcaggttcatatgtgctaagagctaatgaatcctcatgtctgctctttgaaactgttcaaaagccaatgaagacgtacccagacatttagcatttacaagcacctggaccactcttgccatgtcatttactcattaaaaattaagttgaccatttagtgtgtaccaaatattgctttatttttcaaggtagtccaagatttgagccctagtaaatatgttttcagaaagaagcctaatatagatgacttagtgctgatgggtactatttaaattattctatatgaagtattattttaaatttgaatgcttcctgccttctcaaatggcaagtttttggagcctgcctctttcggcctcttagacattttaaaattatacctgcatgctttgttcagcccaaggttgttatttctgaagatgctaggaatctggaacccagaactaattttgtaggcggcttgtcgaaaattcctcccttccccctcaaaaattctaggcagtagccataagacaagctacagaacaagaattaaaacttgataaggggcatccatagatcaaataatgaatctaagtacttgtaagatcccacccaacctttaataatacctttccctcgggggcattgtaaggacttaaagatcctgtacatgaaaaaacattgtaaagtaccatgcaaatgctagttttttacatcgaattccatctattaataatcatctaaattcaagcattttctgttactagattattagctattaggtttattaatattttggtaatagatggtatgattatagtggaatttatttgtaacaggatttagcctatacttgttaatattttggttgcactaacctgggatttctcttagtgtcatagcacccagtataataacgtacgataacaggcattcaagaaagatttattgtttaaagaaagttgtgtaaaccttctgcatagattaaattgaattggtttatttcttgtaatatttcaaaatatattaagagattctgttataattctacaagtatgttttcctgtctttaaaatgaaaataacaaaacaacccacctcattaaattcatcatgtggattaaatgatataatccagagtataatactggtttatagtcagtgtttgatgaaagttatgtattattaaaattatagttgatttttatagctttttaagttcatttcacaattacttatctgctactgtatattccaggagcggtgctagactgtttagctagatgacatgttccttgcccctctggggctatcatcatattttattctccaagtgcatcaaaaaagagacattaattattatctgtgtgtgtgtgcacgcgcctgttttaaacaacatttagatgcaaaaaggagacagagaatagtgctgttcaatagaagtaaaatatgagctacatacgtaggtttaagttttctggcagccacattaaaaagtgaacacaaataggtgaaattaatttcaacatgttttgtttaacccagtatatctgaagtattatttcactatgtaattagcataaaaattattactgaagtatgttatatatatgtatttgtgctaagcctcccaaatctggtatgtattttacacccactgtacatcttgattcagagtagctacatttcaaatgctcagtggccatataaagctagtggctactatgttgaacagtaaaggtagtacaaattcccaatgctcactttttcaatataaatgtaaatatgtatttagaagtagtcttaggctgggtgtggtggttcacgcctgcaatcccagcactttgggaggtgaaggtgggcggatcactcgaggccaggagtttgagaccagcctggccgacacagtgaaaccctgtctctaataaaaatagaaaaaattagctaggcatggtggtgcacacctgtaattccagctacttgtgaggctgaggcatgagaatcgcttgaacccaggaggccaaggttgtagtgaactgagatggcgccactgtattctagggcgacagagtgagactccgtctaagaaaaaaaaaaagaaagaacgaaatactccttattggttttacttagctggaaatagtctcacagattctgcagtggaacagaaacctgaaacgattaagaacaggagtttttcaaatggggttttcatggtgatactaagagcgcgatggaatgtctgacaggtgtctttggtggcagaagtagccagcctcaatacctatactttgttaaccttttcttcctttttcagttattggtaagttcagttcagctcagctcacgtttactgagttcttgttatatttatagtcctgggtaaatacaagaagaataggggcaggtttgccacctgtaaggcattcacaggctagtgtgtgtgagaatgaataactgtgaccctaagtatactggaataaaggtgtgcataaagttagagtgacaaacagtacttcgagtattctttgcctagaaaggggcagacaattaccttattatccttaaagattatattttatgggtgtgaatattttctgtgtgtcaatagttgaactatcaggttgaaaaaaggaggaacatacacgaggttcagtgagcaggaggagggaatagatgtgccttgaaaaataagctgatcgggaaggcaggggagaagcatgattagactttctctcctggcatcgactgtcatctttgggcagaaaatctgtcctctgtctcattcttccactgagcctttgctgggtgctgtggccggcttagctacttcctactctgctacctactagttctatgtcctttggacatttaacatccactttagtcctatcatttttgctgaaagtaatttttagtaaaataacattttattttactgaagtaacattctttaaatctgtaacatataatagtaatatgtaaaatatccaagcaatgaaatagtatgtacagtattcatatattcccccaaaaaatgtatacacagaaatgtacacaaaagcattacgttgcacatgtttctttgtagttttttcacttatcaagatgttatggccattttaccacatttatgcagatctaactcatggtttttggaggctgccggtgttcacagcatatcaacaatttaatgtatgtaactgtttccctattgatagacatttaagttttccaaggttttgttgttgttgcatgcatctgaggccttctcagtcatctcagccttttagaacagctttgtccaaaagaactttctgctatcatgtgaatgatctataatttgtgcagttttatgtggtaaccactagtcacatgtaactattaagcccttgaaatttggctagtgtgactgaggaacagaagttttaatcgtatttaattttagttaatttaaattcaaatttaaattaatcaaattgattaatttaattcaattgatcaatcaaattaaaatagccaaatgtggctagtggctactgtattgggcaacctagctctagaatctctctcttcttctgaacaatgaaaatcaatcattatctatgctgtttattttgtatacctcaaagactatcttaaaatgtttccttgttcttttgtcttactttttgtctatagaaacgatttttatacttttaatctttaaagttgagttcaagttattcagttaatagtgcttgagattatagttgtgagtttcttaactaggctgtgaaccacttgagatgggggactgtcttttgtcagttgtgtcatcaaagcttaacacaatctcagtgtagatttggccctcacatatttttgatggctggatatgtaactcataagagagttttctgtttattattgatgctggaatactctagaagttattctttttagaaatcctaaaaaccattgttttcttaattgccactttcttttaaagcaaaatgtggaatgatcctggtttgggggtcccaaagatgactaacacgtttagttattctctaaaagaactcacaagactcagcatagagctgtaaccatgcttaagatttattacagtgaaaggatagaaagcaaaattaacaaaggaaaaggttcatgaggcaaagtcaagaagacatcaagtgcaaacttcctagagtcctttcccagtgaagtcacacagggtgtactgaattccttcagcattgaatgatggcaacatgtatgggttctttgggaaatctgctattttattaaaccccaaaatattgaatctatctagcttagttacatagttgcttacctagatgagctatatttaataatatctaattgttggagagatttcaaactcctccttctaactctggtgtaaaacacattaccaatgacagacatagtagtagaaattgcacctaattatacattatactttacttataggacattggcttttaacttttatttgactagtcagactgccaaagatttagagctcacgtggcagaaatgtgtagctacttttgtccaagaaggaaattctatggatacaggaattcagtcactatagttatcatttatgtaagtttcagaatgttagcaatggatataactgttgattatattccttttttccctgctggtagttacatattggtaatgtagccaaccattacatcatgatttaagtttttcttatactgttttctaaataaataagttttctgactctgagagataatagtcagatggctaatgagactcacctggaaataaagtttaggccaggaagggtcgtggctattttcttctacatcaaacccctcaagtgatgtgatatttgactttatcttattctagtctgcagtatttcctgtgtctttccatacttgaacctcctgtattgctgaccttattttctacatactaggaaatttatacctcagattctgatgatgtttatgtttttggcatcctagtaacctttattggatgggctaatttttctgattctaagttaacttgatcagaatatattttggagtaactttattggcagatagtagtcttttaatactttttcatagaatcaaataattgcaacattattataagatccatttgcttatagaatttgaagagacaaggaaattagacataatttatactctaaaagcatttacagtgtgctgggaacgagggacacaaaggtctatgagatgtcatccctgtctttgtggggctaagtggcaagtacatgggttttagtgttagattgctttgatacagtccgaaattcagtacaagcttcagttttccgtttgaaatgtggtgataatcatgattttctacaaagtgcttaacagaatgttatagttagtcttcaataaatgctagctgttgttattcaaggaatcactacagatcagatgctcaagctggattggaataaggctagagtgatatatcactatagaaagattgtctggttgggacctttgctagtttagatacatttctttccttgaccttatttgactcttaaaggttaaacttcaagactgtagaatacttctttaattataatgttagtatataaatataatttgaatcttagaagagtaagattatactgtttacctttttttgtgatgttgcttacatgcctgcaaattccttataagtggaggaagtaattacctttttagcacttctgtcaataaacttctttccaatggactatttaaataataaacatcataagtaaaaatgtcaagtaattgaggaaggtagaattaagtaatgttcaaaagcttaatcacttatcatgtcattttttgtagaatgaataagttttaaaagtctcttccaatattaagattattaaggaattatgtttctgtatatatcatgcaagcatatttattcttatattttatgttttatcttttcaatttaactgaatacacactattatcttaccattcttttaaaaatggcaaacacacttgtatatatagaatttagatcaatttttcctcaggacaagggcttatgcaaagttgagtgagtcagcatttgttgaatctaaggctatgagtaaaatgtgaactaagaatacacttttgtaattcaggtctagttttataaaacatgactctgaaaagttaaaagcagacactgctttggagttttgcctctcactttcattggctgatcatatcttgaattatttcattccactgataactttttctatttatactaatttattactatatatctcatatagtaataaagtatgagctatcatatttttttaaaaaggaatagttataaacattatgtattgtctcatcttctaaccatgatgaatagtaacaaagcccttttttatttctcataatttataagtagataacactacttaagattttcgttatagaactgtctgaaaaattatgctctttttttgcagcctcatgaagtgttgccaacgtgtatgtttttttctgaatccagagttgaatttttgtactctgttttttatatgcttgatttcactgagatgctggtttgtgtctctcctgcgtgtttttttctttatgttttgtccaatttatggggtgaagacttgcatgatggctctttgtttctgttatagatggcttggaatcttatgtttgctgttactctgccaaggtagaatggaggagtgaactgagacataaactcctatccacattttgccatcatctaactttgtggtctttttgggcctcagtttaatcttcggtaaaataaagttgttaagctaaatgaagttgataagatatcttctgactcttaaaaaacaatcccaggattttttgtgtatggtaaacacataacatgaaatctaccttaaaaaattctaattgtactgtacagtattgttaagtatatgaatatttttgtacggtggatctctagaactttttttattttgcatgactgaaactctatactcattgaacagtagctccccacttctccctccccaactgtctggcaaccaccattctactttctgctctaagagtttgaccactttagatacttcatataagtggaataatgcagtattcgtccttccgtggcttatttcacttagcattgtgtcctcaaggttcatctaagttgtagtatatgatagaatttttctttttaaagactaaataatattccattgtatgcatataccacactgtgtttatccattcatcccgggatggacatttaggttgtttccatctcttgagtattatgaataaagcagaaatgaatgtgggaatgtgaatatttcctcaaaatcctgatttcagttcttttgcataaacaacctcaagatcgatcatagagtagattaaaaaaaattttttttgaggaaccttcatgctgttacccatagtggccacaccttttttacattcccaccaacagtgcacagatgttctaatttcttcacatccttgtcaatacttctgattttttaaataatgttaatcccaccaggtatgaggtgacatctcattatggttctaatttgtggttggaaagggtacttagtgtgatttcagtcttaaatttgttaagacttgttttgtgatctcacacgtggtccatcctagagaatgttcggtgtgcacctgagagagaacatgctgttgctgttgggtagaacgttctatgtgagtttgttaggaccatttggtctacagtgttgttgaagtgctctgttttcttattgatcttctgtctggatgttctatccattatttaaaataggatattgaaatcatctactattactgtattgctttccattttcccctttggttctgtcaatgtttgctttatatatctgggtgctatgatgttggttgcatatatataattatcgtattgtcctggtgaattgacccatttatcattatataatgtccttctttctctcttgtgacgattttttatatggacaaccttgctgtcttttggttaccatttgtattaaatatcttctcactttcagcctgtgtgtgtccttaaatctaaagtgagtcttttgtagacgttattatagtgggatcttgtttgggttttcggaatccactgtatgtctttgattgagcagtttaatccatttacattgaaagtacttagtggtaggaaaggacttactattgccattttgttaattgcttttgtctgtcttatagcatttttttggtcccttgtttcttctcttgctgtcttcttttatgtttcattgatttgatagtgacactttgattcatcactcattttcttttcttttttctttttttcttttttttttctgagatgaagtctcactctgtcgcccaggctggagtatagtggcacgatcttggctcactggaacttccgcctcccaggttcaagtgattctcctgcctcagcctcccaagtagctgggattacatatatgtgccaccaatgcccagctaatttctgtgtttttagtagagatgggatttcactatgttgaccaggctggtcttgaactcctgccctcaagtgatccatccaccttcagcctcccagagtactgagattacaggcatgagctaccgtacccagccactcattttcttttgtgcatgttctatgtgtattttttttatggttgccatgggacttacatcaatatctaacaatattttaagctgataacaagttacataaacttcaatcacatacataaactactcttttacttctccctcctttttatgttaccaatgtcacaaattacatctttttaataaagttcatccatttacatggtttttttagttatttatacttttgccttctaaaccctataccagaattaaaagtgattcacgcaccactgttacaatattataggattctttgtttaggtattaccagtaaactttatatttccatatgctctcatgtttctgtctggagtccttctgtttcaccttgcaggactacttttagtattttttgtaaggcatgtttagtggtgatgaactctctcagcttttgtttatctggaaatatcattacttctctttgtttttttttttttgtttttttttttttttttgagacagtctcgctttgtctcccaggctggagtgcagtggcacaacctcagcttgctgcaccctctgcctcctggttcaagcaattctcatgcctcagcctcctaagtagctgagattacaggcatgcaccaccatacccagctaatttttgtagtttttttttttttttagtataggtggggtttcaccatgttggcccaactggtctcgaactcctgatctcaggtgatcctaacacctcggcctcccaaagtgttgggattacaggcacgagccactgcacccggcctctccttcgtttttgaaggatagttttaccagatatagtatccagtatcttggttggcagtacctacccacccacccctgcccactcctttcagcactttaaatatattatttcactcccttcttgctggcaagatttctgctgagaaatctagtcatagtcttataggggctcccttaacagtcccatgattataaattaatttgtttatcaaggaacttaaacgctggaggagggaagagaaagcattgagttatatgaagccagatcttgagacagtcaattataggacacttaccagcttcttttatattaaaggcgaaatctgagcattcattgtattttcagcctctgaagggtataagattcaagattaggaggatcaagagctggtaattacatctcaagtaaatacatattcacaaggaaataataataataaaaaattagtccatcttttatgtaaaattattttccacagatgtctatctatatctgtgttttcctagtgaaacagtccctgttttattttttccatttaattggggactgaatttgggctattatgccttgagaactgtattaagtctaagattatttactgtaaacatttccttcttttttcatttctgaactggccagaggaaaagacacacccttacgtgctttttttagggccaagtctcataaaggaactgtgtactcttagacataaatacagtactttatttctcccctgacagtataattatagcatttgtttaaaagtcacacaactaaatacactagtttataaaatgtcagtaaatatactcattgcccttctaaaaactaagaatctgtcattgtgtcttggtagaaatctttctagaaggggataatgcgttgagatcactgtaagccaatttaagataaccttctgtttttaattaaaatgggaactgaaaagtcagttcaaaaatttgtctcctttcatttgccgaaagtgagagtgatagaattcctgttccaatcaagtctctgcacttgttaaaaacatcatacattttggctgtctgttgtgagatcatagctattacatgcacagctccacatgctgctgtggtatatcgtggtcagggtcattaatgaattaatgtttaattgtcaatgtcttggtggtaaagttaagaggatattttttcctttttgaaattgaattaaaatagatgtcttcgaaggttagaaggaacaggctttctaagaatagaacagatagagaaaatgaacaaatacagtgggcccttgatattagctggtttttcatctgtggattcaccagctgcagacagagcatatttggggaagaaaataaaaataagaatttagcaataaagataatatgaataaacaatatagtacaacaactatttacatagcatttacattgttttaggcattataagtagtgtagaaatgatttaaagtgtatgaaaggatgtgcataggttgtatacaaatacctatgccattttatataagatgcttgagcatttctggattttgctatccatggaatgaggtgtgcgtatctgtgtgtctgaccatcctggaaccagtccctgtagatactgaggaatgactgctggacaataaacttttgaaatatagcatatggcaaataaaattttttggcattacagtttgtgctatcaagtaagtgctttgcttatagtagatatttaccaaataattttgaattgaatttaaaaaaccattaaaatataatttacatctcatgtaattcatccatttgaagtgtacaattcaatggcttttattatatttacagagttttgtaaacattactacaacgaatttgagaacatttcattacccccgaaggaaaccccatgcccataagacgtcactgcctgtttcacccttcctgaccaccccctgcttcttacttgccctatcctagacaaccactaatctaccttctatctctacatacagccttttgtggctgttttttttctcttaccataatgttttcaaggttcatccatgttgtagcatgtatcagtacttcctttatttttatggctgaataatatcctgttgtgtggttatattgtattttgtttatttattcgtcagttgatgggcattgggttgttctgggcattctgctcatataaatgagatcatataacatgaggccttttgtggcttttttttctcttagcataatgttttcaaggttcatccatgttgtagcatgtatcagtactttatttatttttatggctgaataatatcccattttatggttatactgtattttgtttattcatcagttgatggacattgggttgtttccactttttggccattgtaaataatgcttttctgaaaattcatttacaagattttgtgtggacatatgtgttcttttttcttaagtagataactaggaatagaattgctacatcacatggtaattctatgtttacctatttaagaaattgatagaatgttttccaaagggactgaactactttacattaccacgagcagtgtacaagggttccaatttcttcacatattcggcaacacttgttattgtccatcttttgatgatagcttttgcatcatgtgtaaggtggtatctcatggttttgatttgcattccatcatgtctcatgaaattgagcatattttcctgtattggccatttgtttatcatctttggagaaaggtgtattcagatcctttgcctattttaaaaccttttttttgggtaaattattgggttttaagagttctttatatagtctgggtacaaatctcttattagctatatggtttgcaaatattctttcccattctgtacattgtcctttcactttctttatggtatcttttgacggacaagcatttttacgttgatgaaattcatttttccttttgtggcttgtacttttgttgtcatgtctaagagcttagtctaccccaatgttacaaagacttaatcctatattttctttaagagtgttatagttttagctcgtacatttagttctaaaatccattttgagttaatttttacatgttgtatgagaaaggggtccaacttgattcttttgcatgtggatatacagttgttgaattccagcactatccctccgagagactcttctttccttattgtttttttctggggatccttgtcaaaaaccaattgattataaatataagtactcatttctggactctgaattctatttcattgatttgtctttctaatcttatgccagtaccatacagttttgattactttagctttgtggtaaatttggaagtgagaagtttgagtcttcaaactttgtttttctttttcaggattatttagggtatttagggttccttgcttttacacatgcgtttatgatcagcctctcaatttttgcaaagaagccagctggaattttgataaagattgcatttaatttcaagatcaatttgggaaataatgatgtcttaacaatgttatgtcttctaatccatgaatgtatttcttttcacattttattgtgtcatgcatagagattgaaatgaggacttagagggaaatttttgtccattggctcctttatagtacactgacttcagttacttcttattggagtaacctaattgaatgtttcattatgtgaaattttattgtttacataccttaagtgttggctgttcattagaactttacatttctttgaggcaggatatatctttttatttttttgagacagggtcttgctctgtcatctaggctggagtgcaatggtgcaatcatggctcactgccacgttgagctcccagtgttaagtgatcctcccaccttaccttcccaagtagctggggctacaggtgtgcactatcatgcccagttaatttaaaagttttttgtagagacagggtcttcctgtgttgcccaggctggtcttgaactcttggactgaagcaatcctcctgccttgcgttctcaaagtgctgggattacaggtgtgagccaccatgcttggcaaggcagggtgtatcttaactactattgtatttctcagaagtgatgttatagttattcaataaaagcacttttcgattggtgtttggcagctaattataagtggtagaatactagtgacactatgaaattatcattagcaagtaatagctaactgatatattctaagtcttccaattcattcatattcatattattcctctggaaaaaaagagataaatattccattatatattacttttttgtaacaaggcatatttaatatattttaaaaattcattttaggtgccaaatctgattccagttttgatgttcaaattgggaagaccactggaacctatattatataatgatatattgtatactttacctaagcttggtgttcacaaggttagtatgttaattaatttagttggcgaaaaaagtgagtcatgaataatactttgaattctttttggtattatgaaattttaagccctaaattttgccatagtcactacttctcttgttgagctaggaggtaatatctaaagacaaaagtatttattacaatatttaataattaattgttttaaattacttagtatctaagttttcactttggctattctctgagattaggtccttatgtccccaggattgttatctagcccctccaacgctatttttcatcctctaagaaggtgggtaatattgcagcaagctttcttctcagtcttcattttataacaaggggtttaaaaatgcttttggtaacctcgaggttgtctgcattcaagtttatgcaactagagtttcttcaatattttctaggtgtgtataggacaaattctacgaataatacaactacttggaaccacaccacgactaagagctgtcactttgcgcttgctgacatctttgtgggaaaagcaggtaatttcagatatacacttgcatgagtattaaatatgttcctttcactgaaggaaaataattatgtcatatatggcaatgctttggtttagtggtattaatgagtggcatcagtgattgcattgaaaaagttttgatttattgtgatgcatttgtaatgcagttagttaactttcagagaaattgagaatataaaatctcatttctttatttctgaaatgtatctttccatttgcttgagaaagtaatggaaatatagttataaatgattagagcctttgtaattagggtgagatttagccactttcttcttgttttatgaaatcaacagtacattggtgtataagaaaatccccagtaatcactatagcaatcttctctgctgattagaagaacgacagtataatttgcaatgcaaatggaggatttggaggtgaaaatgctgagtaaaaggaagataatgattattcaactcaagttgggaaactaccttttttgtaaaattgccttcgtaggaccgagtctatcctgaactgcagcgtttcatggctgtgtctgatgtaccttctctttcggtgggcaaggaagtccaatgggagaaactgattgcaaaagcagcatcaatcagagatatatgtaagcagaggtatgatgtcattaactcttaggaatgtatatcatgatatattattttgtatttaattttttaattgcaagcaagaggcaagaaaagataggcagaggatatataagtactaataattttttaacttaagttttctgattataaaatgtaataatattgaacaatagctttgagaagtatgtcttttcttttcaggactagtcttgtatctaggttcgtaggatatttatatcgttttctgattaataatttaatattgcagtaaaacatgtgatgttatgttttctatttttctgtatatgaatccctgaaaactacacagtagactgttgtcataaactattctttcttatattctccctttgtttaagtagggagataagtagttttaatggggagaccttatttttggaaatggaattatttgtaattataacaaggaagaaaatgatgatgaatttttatgtatgctgtaagcttttaggaaaacataaagaaattaggaagatgactctgctgttctagattatggattaataaacagggtggaggtgacaagactgaaataatacaagtcaagctctaccatatccaaatttttttttcttgcatgtggtaagataaaaatgtttacagaagaaatggacttgatgcatttgaaactgtagtcctgcagtttcatttgttgatcagccactgcgttgaattcctggtaacgtcattctcacttttgttaatgacagcagtgtgaatgctactctctgaagctgtgcagtgggttggcccagatgctgataacatggatgattcctgtttcaagtaaaatttggatcagaatatacagaagctaagccctagcatttttacctcttttctaagcttccatctttagcaacacaaaaatgacctcaatgtaaaagttactaaaaaaaaaaaaaaaaaaaaaaaaaaaggagttacatgtgtgtaacccaagaattgggagtttgaattttactgagctattggcatggaaaaaaattcagagataaaagttattggctgacattcttattctatataattaaagctgaggctcaggatagactgaatatcagaccagatcagtctactgctaacttatttagtattcctttcagttactacctccagatctgtcaaattttttcattttggaaaattatttccacttgtgggacagtgaaacaatagatttctgacaggcaatttcatcaatttacattttgttaataaaagaaaagatattattgaaaggaaacaaggaattcagggaatagacttgcataaccatgaaattaatggtattctggggatagcacaatatatgtggattagaaaggagaggaaggggaggaggatgagtgaatgaatttagcacagtgcctggcatgagataggagctcagtcggttatagtttttataatttttatccttatcatcattatgataggtgtaaccaccctagttagtattgctactaccacaaatcatcttctgttttcaaattcctgcttttgtaatgagtatctgatactatcaggccagaatagctctatctttactaatctcaattaggtaattcagttctttttaccattattacagccttgagtttttctcaattcagacaataggatttgtgatttagagtgaatgaaatttgttaaaaagtgtctttttgggttatttctatataaaaacgagcataaaattatagcagaaaatgatcatgatgcacatttttgaagaaaaaacatggtgttaatatttgagggtcaccatttagtggcacaagagtatagaaaatgatggatgctttttgtttaggcaaaagatctgggagtgataactgcactttagcattaattttgcttttaaactttcatttcttgtaggccatatcaacatggtgcagatatgttggcagctatttctcaagtgttgaatgaatgcaccaagcctgatcaagctactccagcagccttggtattacagggtcttcatgcactctgtcaagctgaggtaggcatttttaaattgctttggataattttgaagaaaatcttttataaggcagagtgggtacaagaatgtaagattagattcaaataactgaagtctgagtgttcattcccagtgaattttttcttggaaaagtgaagcaagacctactttacaaattctttctagaagggaatcttgaaacatccagtcatgtaggcattctctagagatcaaagaaaaccagacttaagatttttctttcttcttatttatttttgttaaaacaaaagggaaagttatgcctataggagaactctagaatatagttgcttcttaattttgtgattagagagctttagaaacaggtgaggtgaagaaattgtcgttggccagtggcacttttatagctaaaagattgggaaagaaccattcattcctggtgattagactgagtagggtgggtaaatgttagaactaaacttgtaaatcattttctgaacttcagactgttcccagaattataacacagcagagagaatctactgttttagagaaatgttttagagaaatgtggtaattgcaccaaagatcattcattgacctaaccaaaggttttgacttagtgaacatatatacccaattgtagttttttagtgaatgagactaagtagaattctcccaccttaaggttatggtcagttatggttgataatgatagtaatgaatataatgatctgataatataagtgacagccatattgagcgttatgctcgtgtccttgggctaagcactttttatgtatttttcttaacaactctgcagtatagggattaacaccattttacagatgaggaagatagaccccagagagaggttagatatttacgccggatcttggtatgagaatacacttctattatttttggtgaacactcatttcagcaggcagtgaacatcattgctgtttaaaaactgatgtgtggtaaggacaatgctttcacatcctgtgcccaatatttggaaaagttgttagaacttaatggcaaggggctattatagcaggagaataccacacatgcccaaggacatttgattttactgcttctgtcagtcatctgagattgggaaatatctctttaatagttatattactttcataataagtaatcctgaaatctatttttaaaccagttttgagagaagaaagaattctaaactttcaccaccaaaaggtgaccatttttactgttttgttgtatttccttttcattattttttcctaacaggcatcaactaatttctgaaattaacattttttcttataataaatagtaatttagccttattgcttttatgattccattgttttctctgcccatcccctcctgttactataaggctgtacagtttatcaatgctttttaattcataagaaataccctgagtttggcactgactttcctcattccatttctctaagacatcatcattaactgtggttagtactgaagataaatttttaggcactagtgtacataatatatatcagttgttctatgtgtcctttgactaatttagttagcttctctgaaactttgttccttcaaatgaggataaaataagattatacacaaaaaagacctagtgtaatatctgctcacataggtattaataataaagcactaccactaattagttaagttcattttattagaaaaagaatgcttattttcttacctcttgtttttcgtctgttcattcttgtctagaaagtaaattattttatcgatgcttactaaagcaaactattttattgatgcttactaagtgttatataccagttttctttatagatattaccaatgtccagaattgtggaatttgttgaaaatgactgcattactattaattttggtgataatttttttttaatgtttggtaatgaatagctgtgtgtttaaataagtagatgtaatctattttcctttgaggcttgatgatggtagtaatatatctttctgttttgtttaaggcttttcaagctttgcgtgtgtgtgtgtgtgtgtgtgtgtgtgtgtgtgtgtgttcattatttgtgaagctgctgctatgtcctgtgatgtgtgttacagtcataaagtatacttggtattcaccagctcttgccaggccacatttactaactgggggctcatcttttgttttgtgtccagagtgctattcacagaggtcagctcgcattctgtgaagccagttattttgttttctaattgatatcatgtgtgaagcgtgatgtagtcaaggtttcaagaaggaaaacattcagcatagttataaatccatttcctggtggcatttggtaatgatttgtctatctgttactgtttagatccttgactatcaaatataattaggtatatagaaagacagcctaatttggtaaaataaaacaaattaataaagataagagaataaattgaataactctatctttaagaaaataccttagttggaaaagtacccagaattggattttgtagggctttcccaactttgcctttgtaaaataagtagtgcttttttcacccttaggtttgaaaatgaactctttcatcttgaaagttataatcatgaaattcttttgtctttgcttgcatcagattaagtttagaattattgctgcttaattatttatcctagacatcaatcaaagattaaaagagtggattctgtctaccttccaactctttcaaggtaaagattgtgttttcaatatgggtttctttagtgctactttgctgaacaaacaacagagagggaaggttgtaggaatcttggctgaccataaaggcaagaatttagtctggctgtctggaattggtaaagagaaatttgtcccttccttaatgctgttgatgtattgatttgggaatttacaagtttgtttttagggctgaattgcttttaaaaaattacagctactatttcttgggttctgtaattgttaatattgagtgtcaacttgattggattgaaggatgcagagtattgttcttgggtgcatctctgagggttttgccaaaagagattaacatttgagtcagtggactgggagaggcaggcccaccctcaaactgggagtgtagcatttattcagctgccagcatgactagagtaaagccggcagaagaagttggaaggacttgacttgctgagtcttccagtcttcatctttctcccatgctggatgcttcctgccctcgaacatcagactccaagttcttcagcttttgagctcttggacttaaaccagtggttttccaggggccctcagtcttttggccacggatgaaggctacactgtcggcttccctacttttgaggttttgggactcagactggcttccttgctccttagtttgcatatggcctattgtggggcttcaccttgtgatcgtgtgagtcaagactcgttaataaacttcccttcatacatacatctttcctcttctgtccctctagagaaccctaattaatataagtacctagtgtgaatttggacattttatgatataggggttgtaggacttcattttatattgaagaaacagagcctctggcaatttaatacatggctcacaaaagtagtctcaagactcttcccaagtctcatgctctttggttactcccgggcttgtttcctttgaaaaatgtgggcattgaaagtagtagttttatttatcattacgctatgagtttgtcattttcaaaggaaaataattaatgttcctgcattctctttttcatatcttttccattgagctttctcatcactttttatcccagccaccatcatttgccttaattttcttacttctttctgtcttaatacagaataatggctccaataagaaataatcttttttaaaaagcaattttattgagatataattcacaaagcatacaattcattcatttaatgtatataatttaatgagtttaagtatattcagagagttatgccaccatcatcacaatcaattttaggacacttttaactccccacaaaactccataccgtttagatgtcaccccctaatctccatattccacatttctcctagccctaggcaaccatgagtctactttctgtctctgtggatttacttattctggacatttcttataaacaaaatcatatgatgtgttgtcttttgtaagtagcttctttcactcaacatattttcaaggttcatccatgttacagcatgtcagtactgtatttctttttattgttgaatattattctgtttggctctaccacattttatttatccacttatcaaatgatggacatttgccactaacagacaaatggataaagaaaattgtggcgtgtgtgtgtgtgtgtgtttgtgtgtatgtatgtatgtatacacaccatggaatattattcccccttaaaaaaggagatcctgccatttgggacagtgtagatgaacctagatgccattctgataagtgaaataagacagacacggaaagaaaaatattacataatctctcctgtatgtggaatctaaaaataaagaaagagctccgatacacagagatatagaataaaacagtgtttaccacagcagtgagagggaagaggaaataggagatgtacgttaaaggatacaaaatggaaggtatgtatgaacaggtttagatatcgaatgtaaaacatgaggcccaaggttaataaaattttattttgttaaagatttttattaaataagtagattttggctgggcgtgttggttcacacctgtaatcccagcactttgggaggccaaggtgggcagatggcttgaaaccaagagtttgaggctagcctgggaatcatggcaaatcttgtctctataaaaatatgaaaaattagctgggcatggtggcacacacctgttgtcccagcactcaggaggctgaggtaggaagattgaggctgcagtgagccatgattgcgccactgcattccagcctggatgaaagagcaagactctgtctcaagaaaaaaaaaaaaaagagagaaaaagtagattttaagtattcttgtcacaaaaaaagtaactatgtaagatgatagatatattagtttgctccactgtcacagtcattttactctttctttgtattccatgacatcgtgttgtaaatctcaaacataaacaatagaatatatatttagaaattgatggacattgggattgtttctatttttggctattttgaataatgctgctatgaacatttgtgtacaagtttttgtgtgtatacatattttcattttggtaggtagatctctaggagtgggattggtgggtcatatagtaactcactgtttaaccatttgaggaactgccagactattttccatagtggttgtgcaattttacatttgcaccagcattgtaagaaggttctaatttctgcacatcctcaccaacacttttttttccaagaaagtgattttatttttaaaaattttgatttttattttaagttctggggtacatgtgcaggatatgcaggtgtgttacataggtaaacgtgtgccatggtggtttgctgcacctatcaaaccatcacctaggtgttaatcccagcaggcattagctatttttcctaatgctctctctccccgcaacccctcccctgacagttcttggtatgtgttgttcccctccctgtgtccatgtgttctcattgttcaaatcccacttataattgagaacatgcggtatttggttttctgttcctgcgttagtttgccgaggataatgacttccagctccatccatgttcctgcaaaggacatgctctcattcctttttatggctgcatagtattccatggtgtatatgtaccacattttcttgatctggtctatcattgatgggcatttgggattgattccatgtctttgctattgtgaatagtgctgccatgaatatacgtgcgcatgtgtctttgtaatagaatgatttatattattttgggtatatacccagtaatgaaattgctgggtcagatggtatttctagatctagatctttgaggaaaaactgcaccttccataattgttgaactaatttacatttccaccaacagtgtaaaagtgttcctatttctccacaactttaccagcatctgttatttcttgaccttttaataattgccatcctgactggcatgagatagtataaacttgtggttttgatttgcatttctctgatgatcagtgatgttaataccaacactttttattatctgtttttttttcaaactatagccatcctaatgagtgtgaagtgatatcccatgtagttttcatttgcatttccccgatgactaatattgagcatcttttcctattatttttggccacttctgttacctttctggagaaatgtctattcagatcctttgaatattttcttcattgcttttaacaataaaaaaatgtaaatgatgaataaaagaattctgtcctgatgcctctaagtaagagatactggaaagcacgagcttggtttgtgggcctttcactacaaagagagcttatcaaaccataggagagatcagatgaacatatatcatgctcttctttgctactttgttcacatgtaacattttctttgtttttatatgaaattagcataatgctttcagctggaaaactgctaatgttttaataatatttgtagcagcagtagtaagcatctcttgatttactgagtactttctatatagttaacagcatatatataataaagtcattatatttattatctcatttaattcttacaatagaagaaaaccccaattgtgacaggtaccgttttcttctgagaggttgacaaaagttgaataattgcccaaattcatacaactaaaatgtagtagtcaggactcaaacctaggtctgtcttaatacagtttttattaagataaaattcacttgctgttattatgtgtttttggtggttgtgtttgtgttcactttaccttgtcatgttgtgttattggagaaaactttttttgagaatgatacttggactttttttctgtccttctccatttcctttgcgattggttaatgtataatgttttgcattattaagactttgcctaaaggtcttaatgaaaaagatgttttgagctaaaatatattaatttttagtgttttactgattgcatattacactttatattaaaggtgtgtggaagtgtttttatcccatttccaaagatgttaggtttttaaagcatcacatttactttgggtaatgaaaaaaagtagtatcacttattagtctctcacaaagctgttttcattttttcatatcccttttcattgtattttctttattcattatttcacagagtttctgtgttctctaattcgtttacattttgctagaaagatttttgatgtagcgacatattttaatggcttactttccgttgaatgaaaatattagtaatcaatgattcatttttgattgaatatttaagttgcttcccatttttctctcttatttgtttatcgagatggggtcttgctctgacggccatgctggagtgcagtggtgtggtcatggtccacagcagcctttatctctgggtgcaagggatcctcccaccttagactcctgagtagctgggactacaggtgcatgccactatatttggctaacttaaattttttgtagagacagagtctcactatgttgaccaggctggttgtcttgaactccttggctcaagcagtcctctcaccttggcctcccaaagtactgagattataggcatgataatctcatgcctggcctatgactacctttaaaggatgtttttgaaattcattttattgactagggatcttatttaaatccgtagttttaaagcaattattctgtgttttttttatggacagccttttcttttaaaagaagatgaagttgtcattgtgttgttctagaggtatttgggtttgtggtttaagtatacaagggatcctcttgatatcataatctcgtaaaggttattgtctgttcccaaagatgttcaaatagaatggttggcagcctttcagcagtgttcaggccagttatcatttattcattctccggtaggaagaggtggtgaggagagcaagggaaagtacattggcacagcttctctttcaaaccctgtctgttgcaacaacaaacatgaggtagagatttctgtaggtaggacacaaaatgtgttaaccttaaaataaaaatattgaaaacttgagccaggctgtgcaaggctttctgcatataaagatttatgagacatttttggccttctaggagctcacagtctggtaggggaaacatggtgttaagtacactaaatgtatttaaaatttagaaatgttcgggggagagatagaagacacatcaacagaatatttcaaaccttaagcagcatcctcaggttgcagagagacagattaggaactggaggaaagaggctcaatagctcacctgtatgtttcttttttctttatacattctgtgatattgagatataattcataaatatacaattcacctatctatagtgcataatttagtgactttttgaatagagttttgaaaagcttactaaaatcaattttagaacattttcattacctcagaatgaaacccacatcccttaagcattgaaccccaatcctcccatacctccctgctttagggaaccagcaatctactttccgtctgcatagatatacctattctggacacttcatatggagtcatacaatatattgccctttgtgtttggtttttcaattggcataatgttttcaaggttcattcttgtggcaacatgtatcaatactttttatagtgtctttttagggttgagtaatactgtgttgtatggctgtatcagttgatgaacatttggcttttttccatttttttggctataatgaataatggtgctatgagccttcatgtacaagctttcatgtcaacgtatgagtttcatcctttttttggtgtatatctaagagtggaattgctggatcatatgataattctatgcttaactgttttgaggaatgccatactgttttccagagtagcagttctgttttacattctctccaacatgtacttttcttctgttctccccaaataagtcagattctcctggatagatgttaccactgaagcattttagctgttaccttcattctttttttttaatttttaatttttgtgggtatatagtaagtatatatatttatgagggtgcatgagatgttttgatacaggcacgcaacatgaaataagtacatcatggagaatggagtaatcatcctttcgagtatttatcctttgagttacaaacaatctaattacactctttaagttattttaaaatgtacaattgagttattattgactgtagtcactcaattgtgctataaaattcttaatcttattcattctcttttttctttttgtacccactaaccatccctgcctccctaccagtcctccactacccttcccatctttctgtgtctggcttatttcacttagcataatgccctctagtttcatccatggtgtggcaaatgacaggacctccatttttaaggctgaataatattccattgttaatatgtattacgttttctttatccattcatcagtggacacttaggttgtttccatatttgagctattgtgaataatgctttaataaacatgagagtgcagatatctttgtaaggctgtgatatctttatgaggtagtgactaataaacgtgggaatgcaaatgtctttacaaagttgcatatactactttgtgtatatacccagaagagggattgctaggtcatatggtagttttatttttagtttctttaagaacctctatactgttttctgtaatagctgtaccaatctgcattcccaccaatagtgtaatagggttccctttttccatcaacattctatatctcttatgtttctgataatagtcatcctaaagggtgtgaggtgatatctcatagtggttttaatttgaatttccctcatgattagtgatgttgagcaataggtatcatttttcaagagttaccaatagcagtcctgaatggtttaatgtttattataataaggatgtttgtcctggtataaaagccactaacatttatataaataaaagtttgaaaacttatggcttattttctttgattattataggattaatatttttcaaattgattccaatattaactaaagataaacatactaatatctactttctcttgataagacaggaagatctcgcagtacctggcttgctttttcacatggcagcgaccacttggtgctaagtagcagttagaagcttcctttagatgagtgtgctttctaatttggtgcacttctctaggcttatagatttacatcatctgcctgacccaagtagtccttcgaagtgtgtcctttattttagcattgcaagtaacttcatatgtgatctcaatttgtctctgtaacaactctctcttcaacttcacaaactgctcttcaaaaaagttatatgattgactagtaaacacatagaaaaatgtcagcatcactggtcattgggaaatgtgcacaccactggaatcactaaaattaaaaagactgacaatactaaatattggagaatatatgaagtaactggatatctcatatattgtaaatgtacaactactgtggaaaagcattatgcagtttcttataaatatgaacataattctacctgatgatccagcaattccacttctagatacttacccaagtaaacaaaaacatgttcaggtaaaagacttgtacggaatgttcatttcagctttgttaaggatagcatatttgaaaaaaacaacttgatgttctttattcaggaatactgtgcagtcataaaaaagaacaacatcatgtccattgcagggacatggatggaactggatgcccttatcctcagtaaactaacacgggaacagaaaaccaaacaccgcatgttgtcacttataagtgggagctgaacgatgagaacatatggacacacagaggggaacaacacacactggggtctgttgtgggggagggggagggagagcatctgagaagaatagctaatgtgtgttgggcttaatacctaggtgatgggttgatctgtggagcaagcatcgcacacgtttacttacgtagcaaacctgtacatcctacacatgtaccttggaacttaaaagttggaaaaaagaaaagaaaacaactcgaataaccattatctggtcaatgggtaaacaaatcgttgtgtatttgtataatagaatactagtagcagtgaaaaggaatggaccactgctacttgcaacaacacagatatatcttgaaaacatgttcagtgaaagaagccacataccacgcgattccttccttatgaacttcaggaacaggcaaaactaatctatgtgtgtagaaatcagagtagtggtagtcttggggtgggagtagggagatagaccagaaagggacaggaggaaattttctggactgtggtttatatttgcaccatccagtataatagctgttagccacatatggctagtgatcacttgaactatggctaatcccaattgtgatgtgctatacatacaaactatataacattagtatgaaaaagtaaaatatcttattgataatgttttaaaaattgatttcatattgaagtgagaatttttggatgtattgtgtcaaataaaatatatttaaaataattttaccttttttacttttcagatgtagttactagaaaatttaaaaggatacatgtggctcacattgtatttccttggtctctattttaattgaggtggtaattatacctttatacctgtatttacatacttgtcagaatttatcaaactgtacaattaagatctgttctttttacagtatgttattctacttcagtaaatcaaaagtataaaagctacctttttttcatgccatgtacaatgtttggtgtttggtgtgcattacgtcctgtattaaacttcataataatcttgtaatgtaggtgatatttactaatgggtttagaaagtctaagtaacatacccaaattaacttggaaatgtgttgtaacatggagatttggagatattctttcatttgactataattcttatggttttgcagttgtatcatgttgccttattaattgtgataaaagtgtgagtgtagtttaggaacaatttaaattttactatcagccattgactgatttctcaacctgtgctccatgttgtggtgaatgagtcataatatttctgaaaggtaattctctaactgggtaagaatcaagtaacattgctactgatgtttcaaggagaaaaagaatgttcagtctaaacaaattgtccagggttggagaagaaatacaggatgtgccgaaattaaaatcaatacattgttctgaaagagagagattaacttttaacattttgtctcccaaagtcttgagatgggaatgtgaggcagtgccactcctgtgttttcctaatcagctgtgagtctgttgtagcaaaaattaataggcgttgcaagatcatgaagaaaagctctttcatcttgcccagctccaagagggtgctatattttcaaagccaagcattgtatgattgagcaatagataaggaggaggggcggcctttcctggggattcttgaccgctagaagagttcatttcaggccatttgtcacagcagtgatttccccggaaataccctgtgccaaggttatgttttggctattctatccccttttatttatttactttctgaaatcatggtggaagatagttgtccctgccctctctcatcatcctaaccctttgtctaggggctcctttggagcactatggggtgggaatgattttcaatgggactcagcaggtttgcaaggttttagggagttagtgtggtataaaaatggccaatagaaatcctgcattttgtttaagcattttttagcgtggtaaatataatttaatatggaaatgtgatccattgtctgatggcaggttttctcagctgtgtacagtaaggcttctgtcgcctactgtggattcagtatttattacactctggaacctcttttgttgttcttatgttttgtttgtgggacttttaaaggtggattgcctgtctaaccttgcagaagagtttattaaatttaatttgctatgcattagagaatgaatttgttggtctttttgaacagcgctctatgttatttgtagttggggcatgtttttttgatgccttcagttcttcctgggcatgaaaactctttttgtacatttgttgaatctatttccatgctgagctttttatatactacacaatgactctttgcagtcgaaagttgtagtttggccttatttttaactttaaaaggacagcaggaacttaccttttattaacattcactttgtcaccctgcaagtagatttttaagtatggtttttcattatcaaaatgaaattttaactgactgtgttattttttttaatagaataccattcagtacacataagtcatatatgaaacgggtagggaattaaaaaatgaaaggtttgttgcttaaaaagaaaacaattatgttgactgctctttaattgattgttttattaagaaaaatttggagatcatggaaagttgaatgctatatcccaacttataatgggaaaattttaaatggaggccttaatattttaccacttaaaatttttgcttctatcctccagtccccttttctctgctctctgccctttagtattcccagatttgttatcatcatttaagacactttactctgaaaatttacaatctcaactttcgaagttactacatttaggatctccattgcccccgtgctttatttttatccattttgggggtttattttgtgtctcaaggctttttgtatgaaaagttctctcacttgaatcaaaatcatggtctctgaggattattagctgacatgagtagtctgtgaccaaacctgaaggctgttcagggtgtccagccgtgagtttccggctctcagtcacaaaccgagggcattctttaaaagatcaaacaagctggacactgggagggttttaatgatgccagttaacatcagaggagctgggctcagtggttgcaaattgtgctcatctgaataaatgccactgagctggaaataatgacatgactaaaatgatggtaattgtgtgctgttctaccattccagtgaataaaatatactggtttaagcttatataatgggtagggtttttttttgggaggggggttggtaaatggggacagggagtgtagagacagagtcactgaagtagggcagtagacaaaatgacgttaatgttttgaaaaggttttggaatttgaaatctgattggaagcattatgtttgtacaagaattattatatctgtttttaaaagtattttattcagcatgtactctcaaatgatctagaattaaacttttataaacaatggtgttatttgttgggcttaaactcgtttctgtgctatgtaaacatgtccataagaacaagaccatcccaccttctccatgcgtaggataaaataactaagagactcatttctaaaaactctagtgataccaaattagacttaaccttgattatatgaataaaataacatatactgaaattgttaatgaaagaagttaacttgcttaaaggaaatttggaattaagacagcgagactggtaagtcttttcatagttatataatttatcagaaagcctcactagcatgcatataagcccagaaattgtatttaaacaatgcaatgtataccttttcttttaaaggtgtttatttttaagtttagaaacgttatagttgaaggaataggatttcttagagtttgtggtctgtactattagttggaggtcattctaaagcctttttcatgttttgagtatacattagttatcttttgtgatttagatgacattataccacataggtctttttttttttaattttgagctttattaaaagctgggcttatttcttttcacaatagcctggtggaatgtattatgccttaggttctaaattcagcagtaatgagtaagatgttctctgggggagaacattctttttgcttcagagccatggcacactgcctctacttatgtaaattgtcatttgagcaatttacttgcttaaacaatttacgaggtcatatgactttgatctgaaatggtagaataacaggtcaaacaaagtgatgtcattgaccttatttcatttatgctacacttgtaacctcaataggagtgcatttccttctattccacttgtttggctcaggtactctatccatgttatggacttcatagaaaagtgattggcagtgacttctactatgtagagtaggatctccaaagtttatagatagcttaggctactgaatccaaatctctagagataaagcttagactgtttattatttgagttccccatgactttgatgtttagtgaagtttgggaccattcttaagaacaccagtatctaaagtgatttatgtataagcctgcccatggggtatggaaagaaaatattagagtatttcttatttatcttttatctttaaaagataaattaagctttactaatatttaacgtatggattggtggtttccttacttgcacttacaccagaggatcatgtgttatgtacagtagccaggtattctgaaggaagaatggagagttccacaataaagattggttgtagcaccatctctctgttagaatacagcattccctaggagtttatgcataccagttatatgaatttatgttgtgtgcctatataggggtgtgtgtgtgtgtttgtgagtatgtgtgtttccatcattttgttagccatgcttattccaggtgtggattgttataaggtttatgtgaggcactgttaaccttggctttatggaatttctttctttctttttttttttttttttgagactaggtttactgctgttgcccaagctggagtgcagtggcacaatcttggctcactgcaacctctgcctcccaggctcaagctatccttctgcttcacccttccaagtagctgggactacaggtgtgcagacccgtgcctgactaattgtttttgtattttttgtagagactgggtttgccatgttgcccaggctggtttcaaactcctgagctcaagtgtcttgcccgcttaggcctctcaaagtgctgagattacaggtgtgagccactgcaaccagcctgaatttctgtattctttatggttatgcttaagcacaactccacacaaaaattactttcccttttttttgaactatgcaatcacttaatttttttttatttttaatgtttatgggtacataagtgtatatagttaaggggtacacgagatattttgacacaggcatacgatgtctaataatcacatcaaggttaatggaggtatccatcacttcaagcatttatcatttctttgtgttatgaacattccatacctggccctgatttgacttttttatatgctaagagataagggtcaagtttcatttttctgcatatgattatccagctttctcagcactatttattgaggtgactatcctttccccagtgtatgttcttggcatctttgtcaaaaattagttcactctagatgtatggatttatgtctggctactctattctgttccgttggtctatgtgtctgtttttatgccagtagcatgctgttttggttactatagctttgtaatgttatttgaagtcagtaatgtgattcctccagttttgttgtttttgctcgggatggttttggctattctgggtctttcatggttccatataaattttaggattatatttcctgtttatgtgaagaatgtctttgttattttgatagggattgcaataaatttatagatttctttaaataatgtggacattttaacaatattgattcttccaatttatgaacatggaatatctttctatttatttttgtgtgtgtcctcttcagtttctctcatcaatgttttatagcattcattgtagatctcttttacttctttggttaagtttatatttaggtattttattttatgtagaggtatatcattttattttattttattttattttatgtagagatcttttacttctttggttaagtttatacttaggtattttattttattattataagtattttaagtggaattactttgtttttttcatattatttactgtttgcctgtagaaatgccactgattttttaatgtttttttttttaattctttaactttcctgaatttgaagtctttaggtttttttccaatataagattatatcaactgcaaaataaggtaatttgacttcttcaatttggatgccctttctttctcttgtctaattgctctagctaggacttcagttctatgttgaataacactagtgaaaatgggcatccttagtcttgttctagattgtagagggaagaatttcagctttccctcatttaatgtaatactagctgtgggtctgtcttacgtggcttttattatgttgatgtatgttccttctatacccagtttttttagagtttttatcatgaagggatgttaatgttgaattgtactgaatacttttccagcatcaactgaaatgattatatgattttggtgctttattctattgatacgatatgtcatattgaattgcatatgttgaaccatctgtgcattcctggaataaataccacttaggatgaatgatctttttaatatgttgttgaatttggtttgctattattttactgaggatttttgcatcagtgttcatcagggatattggcctgtaattttctttttttaagaaaattgtttatcttttctgattttggtatcagtgtgatactggccttgtagaatgagtttgaaagtacttctgtgtcccctattttttgtaatagtttaagtaggattgattttagttcttctataaatgtttagttcttctataaatgtcttttgattgcagagtttaggccatttacatcagtgaagccatcagtttctgggcttttttttttgatggaagactttattttggcattgctctccttactttttatgggtccattcaggttttggatttcttcctagtttggtcttgttggtatgtgtctaagaatttattagtttcatctaagtttttcaatttattgtcatatagttgctcattggtagcctctactgatactttgaatttctgcagtattagttgtaatatctccttattcatccctgattttatttgggccttctttttctttttttaattagtctggctaaagatttgtcagttttgtttatcttttcaataaaacaacttttcattttcatcttttgtattgttttcttgacttcaattttatttatttcccctttcatctttgttatttcttttcttctaattttgggtttgatttgctcttgcttttctagttctttgatgtgtgtcattaacctgtttatttgatgtttttctactttattgatgtaggtgcttactactattgacttctatcttagtagtgcttttgctgtatcccataggttttggtatcttgttttcccatttttatttgtttcaagaaatttaaaaatttccttcttagtttctttattgaccccactggtcatttacgagcatattgtttaatttctatgtgtttgtatagtttccaaagttattcttgttattgatttctagttttattccattgtggtcagaaaagatactttacatgattttttttttcaattttacaatactatttgtggcctaacctttggtctatccatgaaaatgatctctgtgcttaggagaagaatgtgtatttctgcagctgttggatgaaatgcagtgtaagtgtctattaggtctatttgttctgtactgcttattactttttttgttgactttctgtctggataattggtctaatgctgaaggtggggtgttgatgtctgcagctattattgtcttggggtctgtttctcactttagctttaataatatctgcctttatatctgggtatgccagtgttgggtacatatatatgtatagtttttttatcctcatgctgcattaacccctttatcattatatcctgaccttatcctttttacagactttgtcttgaaatgttttgtcattgctcctgctcttttttggtttccattggcatgtactatcttttccatcccctttatttcagtctatgtctgactctataggttaagtatgtttcttgtagacagcaaacagttgaatgttgtttcttcagtctattcagccactgtcttttgattgcagagtttaggccacttatattcaatgtgattattgataagtaagggcttattactgccattttattcattgttttctggttgttttgtggtcttctctaccatacatccttcctgtcttcttctttgtgaaagtgattttctctggtaatatattttaaatttttactttttattttttatatatctcctgtgggttattgatttgaggttatcatgaagctcgcaaataacatcttacaacccattattttaaactgatgagaacctaactctgtaaaaacaaacaaatctaataaaaactctacactttaacttcatcctttatgctttttatctttttgttgtttctatttatatcttatatactatgtgttaaaaagatgttggtattatttttgatagctttattttttagtttttctactcaagatatgagtagtgtacataccagaattacaatattataatgttctgtatttgtttctgtacttactattaacagtgaattttgtgtcttcagatgatttccaaatgctctctaacatccttttctttcagattgaataactcctttagcatttcttgtgggacaggtttgatgttgatgaaatccctctgattttgtttgtctgggaaagtattttctctttcgtatttgaaggatatttttactgaatatactgttcaaggatagaaatttttttgcttcagcactttaaatatgtcatgccactctctcctagcctgtaatgtttccacagagagtctgctgctagacttattggaacgattttatatgttatttgtttcttttctcttgttgcttttaggatcctttaaaaatccttaacctttaggagtttgattcttaaatgtcttgaggtagtcttattttgattaaagctgcttggtgttccataacctttgtgtacttgaatattgatatctttctctaggtttgggaagttctctgttattatctctttaaaaatctttgtattttgatctttctttctacctcctctaggattttccttagattttccttctctatagttcatgtatacagcatgtaatgaaatacgcatatattctagtgtgctactagtagtggctgccacttaataaataagggattgaagaatagtggcttagagttggagagacagtatttagccatggaaaatttaagaaccacttaggactggttagggtttagagtcagcagttacagagcaatattaaaagagggtttgattctaagttatgattctaagttagaaatgaaagacaaccttgggccaggcaagtgaacttgctttctaagccaactccagttccttgaaaagttaaacatagagttactatatgacccaaaaagcccatttctaggaatgtacccaagaaaagtgcaactatgtaaactatacactaaaacctatgtatgaatattcatagcattattcataatggccctaaagtagaaaccacccagatggccatttagccaactgaccatttttatttttatttaatcattcatgtttatttctccacctaaaatttgtgttcctactgtgcataaggcacttttagatgttagagctgtaatgagataaagggcagacatggttctaaccctcaggaaatttccttttttttttttttttttttttttttgttgagacagagtctcactgtgtcactcaggctggaatgcagtggtgtgatctcggctcactgcaacctctgcctcccaagtttaagcgattctcctgcctcagcctcccgagtagctgggactacaggcatgtgccaccacacatggctaatttttgtatttttagtagacacagggtttcactatgttggccaggctggtctcaaactcctgacctcaggtgatctgcctgcctcggcctcccaaagtgctgggattacaggtgtgagccactgtacccggcctcatctaaccattgatggtacacttacctatttgcagttgtgatgaaatctacaaagcagagatcgaagtcactttgggtatttagaggatttaaactaatctgagaatatcagtaaaattagtattattagtgagatattttctaattgttaagttaataatgaagttaatgtgatgggtttattgagtgatttttgtttctctttcgtgaaattttcctatcccttaggtttgtgtccttctctttttatttcatgcttccttctatatttgacaacttgacttactgtaaatgtttattttcatgtttgtatttctgtgagctactttgggggcataatccctttccgatttctttcgtaatctctagtcctagtccttaatagagggcagagtttattatgagacttcagtgtctgcttctttatgagacattttgagttgtccaggaaatgtctaatttcacaatccctccctcactgactcaatcagtttctacttattagaatatgcatattggtttttaaagtatttttaatgcatgagacacatttgatgctcaaaaatcagaaaatatggattagcagaattagaagcaaaaatttacccatatgtcactatccagatataactctgataataatttgccatatataatttcatgcatttttctgaacatctctgtatgtctatgggtatttttagaaatgagattgtactgaacatatttagtagaacctgattcttctcctcttgatatattttatgcatcttttcctcgatatatatatatatatatatatatgacacgtggtatatcattgtacatgccatgtattgtccatttactagtcctttattgatggatattttattagattgtttccaattttttactgtcatctacagtgctacagtgatcagctttagagctaaactgtagcacatatctctgattatttctttataataaatttttagaaatggggctgccggtccaaggatgtataattaccatttataaagatttctcccatatggactcctacctgtattatacgggagtgctgctttctctataagcttttctgcataggatataagttttttttatatgtgtcttcatatttgttttggaaaacattgttgaccattgtaactaaatttctgattctttcatttatgtagtaaatgtgaactgtgtgcaaatgctaacataataagcattattgatgatttggttgcagttatctgaggataaactatatgatgcattgaaataaatgtgaaaatagaaggaaatctcaaatgtttattatgaggttttgtactagaaatttacatttactttctattagtatggacttgcggagttgcaaggaggagtgctcagatatcttctagactcaagttagacatttaggcacatttctcagggattccaggctagagtatgtctgtttcagtcattatgttggagagcacttcctcagcctcgtgtgccctgtccattcatctgtggctacacttaggtttctgagggctgaaactaagaaatcactgtggagaaatgtgtactctttatttctgtgtgaagtttttgcccagttttgcctttttcacctcctggagattaggctgcacagaatcaaagggaacttccgaatgtccttttctctttcttaaagcttaaaaccagagccaacctagatggaaacagccaacatctggttgctcctctttccctctcactggactttgtcagctccagccccaaactgttttagcagccaaaagcccactacgtaattgtgaggattaaagagagtgaaggagaaatgacagcttttaaaatctctttaattctaatattaggcctgggagccttcttcaaacaatattatgggagtttcatgattgtacacttggctgtgttggatgaatcagatgccaaatgagcaccctatgtagcaaggcttgttaaactctggaaatggtgttgattaatgtagaaagtagagtgattgccatgtaagtttaattctaatgatacgtatccagcctagtgctgaaaatggatggtggtccaatgtccagttcatcactggaaaattaccctaagctaaagagttaatgtaacagaatgtaatcttaatactgatgccaagagaagacattttagtgcttacccattgccaaatactgtgccaagtctttttataaacatcttcacagtaactttgtaaggttgttattagtattacctttcatgttacagatgtggagactgagggtcacatagctacttagtggcatgggcaaagtttgacctagatttctctgattccaaaacatctgtcaagtagaaccatgctaaatgcaagcacttttggtaaatagctttattgagataaaatttatatataatacagttcagccattttaatcgtgcatttcaattgtttttccacagagttgtacaatcatcaccacaaataagtttgggacattttcatcatccccaaaaggaactctgcattccttagctactgccttcccaatccttcatctctctttacccgagccctacacaaccaataatctacttttagtttctataaatttgactgttttggacattttatgtaaatggaatcatacagtatgtggtattttgtgactggcttatttcacatagcataatgttttcaaggttcatgcacgttgtagtatgttaagtctaaattcttataatgctgctattattttctttgagaacctacaggaagctgtttagtccatctgctcagattttttttttttttttagattcatgcagtattgttttcctggtgtgtgtttatggattgtgtagttaccaccagccatatatttagttggtgtgacaagaatagttgttaattcctggattatgctttggggaaggaggggcgataatcattcttggcaataagagtacataagatatccttggaattatattaggttttccatgtagaagagttttggctttatattgtaaaataagaacagctatagtaaacttccaagtttccctgtaaaacgaaatttaagtgagtgaatagaaaaaacataaatgtcagttcttatgaaagaatgatcactttgccaaatgtctttaaaagagaagacaataattttagatgtcttgtgaaaataaagttttcatgtaaggtatagggtgaagagcaaaataaaattaattttaattatagaaaaatgattaaggatcaaattcataaactgagtatatttcatttaaagtgtgactcaagtattctatgtatatgacaggaaagtcagaaattatggggtgtaggaggtaagggaaaactttctctctgctctctgaaggtttgccgaaaatcactgacaaaaaggagattaataggtgcatacaaatttatttgatcatagttttacatggtatggaatccttcagatgaagatccagagatacaggagaaacagtctgtatgcttagcttcaagaaagtatgggcggccatgtagaaatatgactggacaaaatgggcatgatttgacgctaatagactgagtggggaaacgcagcaaggcctgtccagttaaattcttcttggtctctctaagcatgcattccctccttctgggtctgggtcaggaccctctctggaatagaggtctcatggcctacagtcaataacgtaggtcaggtagtttctttatggccagtttttacacagaaaggtggtggggagggttagagtaatatttttagattttattgctggctttggggaaaagggttctggtttccatgggattctagtttctgtggctagcctcttggaagatggaagggtcagagacaagagggtaagctaaggtcagagagagctgcttctgagatcttcattttggggtatcattttctgaaacctgtaaggggaagaaaagaaggttaaaaatcactataaaccacagggttaaccacggtgtatgtataatgagaaaggaatcatgccgtacacattcttttgcaacttgtttttttcagccagcagtttaccaggggcactatgtcatgttgataatccacttttgacatctaattgaatgaagacatggctgtactgtagtttatgaatttcctgttgtgggatacttaagttgcttctattattattattattattttaataaatcacactgtgataaatgtttttgtatctttatctttgcaagtgtctttattattgggtagatttgcatttctggtgaaatggacaattaggtttgaaaagaattgagaaaaaagaggcattacttctctgtactctcagttcataataggcaagcagtttaaacagaaggtgctttgtttttaatttggaaaaaatatataaaaaaggattttattaatggccaagccaatatacttttccagtacctccttcacttctcttgagtgaaaagagccatgaaaagctttccatatagacatctccctcctttcctagactccaggaccctctactttcttggttctcctactttgctaacatttcttcttggtgccctttgtttcctcttgtttttaaatatattttccacagcatgtggactcttttggaaatcaaccatctatcctctcctttcccccaacagttactgtctgcttcttgaaactttttctggttttttttttctgttttttaaactattgttatattatagatgtttttctggggtattctaatatagtcagtcaaccttaatgttgacttctaggaataacttaaccaacattaatagctcacttacacttgtggagtttttacatatagttttaattttgaactctttattatttgcttaggacagctttggttttgctgtactctcaagagatttgggtccaaagagttagcatctttaatttgcagtgaaaaaaatcattaacgtcatggtttacaaactcgtgtacatggggtatttgaagactttctaagggataggcagccatgttagttttagtaactacatgtccagatcttcaacttcactatgtactcttccctgacatttatctgccttagattaaactgtttctcctttcccagctatcctttcataattgcctcctttctactctgcaaaaagaaggcctatctctacttgtaaatctttcttagttcattgctctcaggtataaaaatttcagggcattgaacaaagagacagttcaaaatattgatttttggggaagcattttttatcaaggaaccatcttgctcttctactgagaccacaccatttctgattttttaaaccttttatgtttggtgattactttccaatatttgtaatatttatgttttgattaattgtatattagcaataatcataacaatgatgcaactcaaaatttaaaaaaactcttagtcttatggtcataagaaataaaaataattttaatttataaagttatttttgttatagaggcatatgagaggtgaccaatagcagactctgaaccattaaatatattagaataaaattatgaagcataactgtaatagaaatacaatttctttttcaaaaacattgtattattttatttttatttttttatttttatagatttaggaggtacaagtgcaggattgtcacatgacagaaatacactgtcgaggaagaaaatctatacaattttggagtgttagaggcattttttatgtggattttatgaaatggatgatggtagatataaattgctatggcattttatctaattgtataaacttagtagaatgttatagcaattttattttaaaatggaagtatttaccatatgttagaaaataaatcttttgcagtctttatacttcttaaatgccaatttacatgatttttcaaaactttttaggagttgcatgagcaaaaagtatttaaagactcctaccttcagttatgctttaaacttgattttcttttatcatatatgatttaattggcacaatttaaattggtataattggaaattaaaaagacacaacagagcatctggtacataattgctctttaatattatttcctccaggaactcctttctgatctctgctctcttccttaaccaggtaatttccccctctatatctagtatgaaacttctgcagtttctcttaacacaaggttttgtaatgcatgtttatgtatcagtctctactacctgatgctaaggtcctcgaagatagaaagtatgttttagcaactgacctcctcctgcaaagcgtccagcttagtacctggtacatagcagttgctcagttcacatttcttgaactgaacaataaagaagataaataattagtcttatgaaaatattagataaccttaagttggtttaagtgtcagggtttgtcttgtctatctctagtgaaaacttattcctttgcatattttgtaggaataatttcaaaagttaccaccttcaaataaagttgaaaaccatgaaagagttttggttttttttttttcgtggggtgggggggtgttattatttagatccattggtatattaaaatttttttccatctagcgtctttatctgtaaagaaagggattagaaaatatgatgtccctgtttctaaaaccagatatctgcataaatgttctgacttttatcttcatgcctcttttaagtggaagagcagtgcggaaggttaaactttggaattcattgtgaatttgactgctttatggcagcaacacatcagaattcctgatattggaacaattcaagtcaaatccagggcttattgctgtcacatttctaatttcctacccgttttgaaattttaaagtaaattcactaataaagtctaatatctggtaactgaaagtatggttttataactagcagcttctgtgtcacctggcagcttgaaacgagaatctcaggctctactctagacctactgagttagaatctgtagtgtgatgagatcctttcaccacagggtattcaagtgtacattaaagttaaagaagcattggtctaatctaattgctaagctgtatccagttaataatcacatagtctagttcaggagttggcaaaccatggctgactcttccaatccagcccactacctttttttgtaagtaaagttttattggagcacaaccatgctcatttgtttatgtattgtccatggctgctttcttgctacagtggtagaactgagtagttgtaatagtgaccatgtggcccttgaaacctaaaatattaattctctggcccttgacagaaaatgtgccctgccctgtcctagctggtgataggtcagttaccaccatgtatttataaatttgttttgagatgagtgcttttttatgccaagcactgtgctagatgctgcttttgtttgggtggaaaaatcttgtttatccttgtttaaaccttgctttgggggaaccatttttgttgtgaatcactagctttctagcactgaagagcaaagtaattcctaagaagttttactaaaaagtttcctttttctttgttgaacttgtagattataggttttgtctttagtcttgattttcctaagaaggaacttgtttgtttctatgaaaagggaccacaggcatgtttgttccttgttattagggagttgtagttagttgtgtgagccactcaggcttaaaagactgattttccctattgtttatccatgaagaattcatcagttctgttatccccagatctgtggatacatagggtgggggtgggaggatagaagaatcattttcattgaacgtgtaatcaggttatgtttcaggaactctcaacattggttacttagaaatgcattcgtggaattctatctttgtaaagtggactaaactcaagaggtattcctaaaaactttatctttgaagtttaaagtttttctctaaagtggtcttagtgtttctgaattgactgcctaattcatcaatttttttgatacacagcatattgattcttaaatatgaaatgacagtaaactgtatttctcagtctctttctacagtacacttacagcctctttagccctttttaacatttagatggatgatatttttattctttttgctagtaaatactcaatttgctttacttttaattttgtatctgttgaacaacttcccagtagttcgatttattgagttttaagctatgttgatttaatttctgttattttcctttattatcttggagtctaacctctattagaaaagaggaaggagtgaccattagaaaaaaatttcctctgattattgtgggggaataaagcactaatcattttcttgtcaaggaattttttgacatattcttcctatgaatttgctagttcatcctggaagaatgtccaccaaaaaatagataactcatacagacagaatctagcaaaactgaaaagtgaatgtccctatagggagttctttgtgtcattctttctgttcctgcagagaaatcaatggaatttgcattggaagatactgttccttgtggaagtatcctaggcacctgtaatttctcactagggggaataaaaaagaaacctaacgtctctggctgttgagtagtgagtctcttgggtggcttcatagtctagatcaatctgtttaataaatgtctctgtttttacttgtgtcacacaattctaaacctgttctattcagatattagaattataagtatgtactacaaagtgccaaatagtttttcagaaatacagaataatttaaaaagtctctgttacacctcttttggaaatgtcatggtgatgttacgggttgttaatatgagagtagctttactacaagtccaaatatttttgattctctaaggcatagtttgggatttagatatgttcatctatattctttgccatgaacaggacaaaagttgttcaactatgttagaaaatcatcagaattactgtcatttagattataagtgagttttaaaaaggtacctcaatatctatatctgtttgtttcttttttccctacaatgctgccttgataataaactagtctcagacattaaaaggctgtgaaattgcttaaataaacctgtgctagtcattttttaaaatacttaacaacccctaaccctatattattaggataagaaagaatgttatttttctcattgtttctgctccattgattgtgtctcttcaaaatctctcttatcccgttattgtgttttggtaacagaagcatcctgttttatgaattgtgtgtgctgaattagcttaagagggcttcactgcgtgatgatgacttgagtcctttaattgtgaaggcagtttcttttgccttcattatgaaaagggcaaataaggcagttttcatagcctaaaggttttttataaagctttcctctgttggagtaaagaatcaggacaaaaggagtaggctgttctcaggaatttctagaaatagcttttgaaagtaaaattaggagatagctctctgttcctctgcaaaagaacaaagtcatttttacagcacaggaattagaaggaaaggctctgattcttctgaggttcactatttttttttctgttggttataacaacaataactatatttttcagtgtataaagtaggtgtacagttgtctccatatgggctttactggtaaccttgtgctgtacatagagcaggtgttactagtattatttccattttgcagctggggaaagagtttgagggaaattaatgacttcaccatagtcacacagctaccaaatcagagacctggatttctgactttaaaacgtgctcttcccagcctaccacactgcataaggtcttctttaatctgtactgtttagtgttggtaagattcttgtggaagaataacatgggaaattggtaagattcttgcggaagaatgacatgggaaaagtatcattctcccccagcaacaaagtatgcataacataaacacttaggctgagatgaattcttcagtatcttatagacagactaagcagaacattctgagtcattcgtacataaatattcgtatgctatatgtggatgatttctaggtattatccctcatgattgattgattgattacatgttttgcccctactattcaatggtagatttagcattgtaggctggcagtttccttagcactttttaaattcctaatctaaaaaccactgcatacccattgatttgcatttttaataattcaactaattttcacagaattaaattaatatttattttaagttaaacttgaatgtgctttacaaagaatggcaatagacagctttttttaatttaaaaggaaaaaatgttatatctggaagaatgcaagcattaaaccataaaaactatagtctaacaaatttaattgagttatatggtaaaaattctcataggaaaagttatttcatcattataattttacatttatttattaaaactttcccatgtataagaaatagtggtttaaaatggtgatacatgggtaaataaaatgtatatattccttttccttatttttctaacattaaatatgaataatagttattaaataaatatgtcaaggaactagcagaagagatgagactggaggaatagatggaaggcagatcatgaaaaaccttgaaagccatgttaagtgttttttccttgtctctgaataagtaaattgttttttaatttttatcattttcaatatttaaaattaaaaaaatttagttatgagtacataatagttgtatatatttatgggatacatgtgatgttttgatatagtcaaactgtgtaatgatcaaatcaggataactggggtatccatcacctcaagcattatcatttatctgtgtttgaaacatttcaattatagtctcttagttatttgaaaatataaaataaattattgttaactgttgtcactctattctatcaaatgctagcccttattctcactgtatttttgtacccattaatcatttctgctgtattccccagctccttgccaccctttgcagcctctgttaaccatcattttacccctatattcttttttttttttttttttaacacttccacatatgagaacatgaaacatttgtctttcttttcctggtttatttcacttaccataatgtcctccagttccatctatgttgttgcaaatgataggatttcattcttttttatggttaaataatattccattgtgtgtctataccacattttctttattcattcatctgttgatggacacttaggttgcttccaaatcttggctattgtgaatagtgctgcagtaaacatgggaatgcagatatctctttgatgtactgatttcctttcttttggatatatttatatattcagcagtgggactgctggatcatatggcagttctatttttaatttttttgagaaaactccatagtcttctccatagtggctgtactaatttacattcctaccaacagtgtacgagggttcccctttctccacattctcaccagcattcattattgcccgtcatttggataaaaagcattttaactgtggtgagataatatctcattgtagttttaatttgcatttctctgatgacgttgagcatttttcatgtacctgctaaccattcatgtcttctattgataaatatctattcagatgttttgcccattttttgagtggattgttagattatttcttattgagttgtttgagctccatttttattctagttattaattccttgtcaaatttatagtttgcaaatattttctcttattctgtgggttgtctcctcgctttgttgattgtttcctttgctgtgcagagctttttagtttgatgtgtgatcctgtttgtccatttttgctttgattgtctgtactttggaggtattactcaagaaatctttgtccagacttatgtcctagaatgtttccccaatgttttcttatagtagtttcatcctttcaggtgttagatttaagtctttaatccattttgatttgatttttatgtatggtgagagataggggtcaagtttcattcttctgcatatggttatccagttttcccagacccatttattgaagactgtcctttcccagtgtatgttcttggcacctttgtcaaaaatgagttcactgcagatatgtggatttatttctgcattctctattctgttctattggtctatgtgtctgtttttatgccaataccatgctgttttggttactatagctctagtagtataacttgaaatcagataatgtgattcctgcaattttgttgtttttactcaggatggttttccttatactgggtctttatgtttctgtataaattttagcattatgttttctgtttctgtgaagaatgtaattgttattttgatagggattgcattgaatctatagattgctttaagtaatgtggacattttaacaatattgattcttccaatttatgaacatggaatatctttcaatttgttttttctgtgtgtcctcttcattttccttcatcaatgtttcatagttttcattgtagagatctctcatttctttggttaagtttattcctatgtattttattttatgtgtagatattgtaaatggaattcctttcttggtttctttttcagattgtccattgttggcatatagaaatgctactgatttttgaatgttaattttgtattctgtgactttcctgagtttaatggtcctaattttgttttggtagagtctctaggtttttctaaatatgagatcatatcatttggaaagaaaaataattttacttatttttttcctattgggatgccctttctttcttttgcttgattgctgtagctaggattttctgtattatgttgaataatggtgaatgtgggtattcttgtcttgttccatatcttaatggaaaaactttcagttttccccattcagtattctactagctgttgatctgtcttatatggcttttattgtgttaaggtatgttctttctatacccagtttttttttttttgagtttttttttttatcatgaagtgatgttgaattttattgagttctttttcagcatcagttgaaatgatcatatggtctttgtccttcattctgatataacatattgcattgattgatttgcatatgttgaaccatccttgcatccctgggatgaatcctacttgatcacgagaaacaatctttttaatgtattgttgaatttgttgtggtggcattttgttgacgtttcacatctatgtttgtcagagatattggcctgtagttctcttttttttgttatatctttgtctggttttggtatcagggtgataatggcctcatagaatgaatttggaagtatttcctcctcttctattttttggaataatttgagtaggatcgatattagttcttctttaaatgtttggtagaaatcagcaatgaagccatcagattattggcttttattgatgggaaactttgttatggctgcaatctcactactttttattggccgattaaggctttggatttctttttttcattaaatcttggtaggccatatgtgtctaagaatttatctgtttcttctgggttttccaatttattgtcgatagttgctcataatcttctctaatgatcctttgaatttttgtggtattgtattttgtgaatgttttttgtaatgtcccctttttcatctctgattttatttatttgaatgttctctctttttttcttagtctggccaaaggtttgttgattttactcatcttttcaagaaaccaacttttcatttcattaatctttttgttgcttttcagtgttcgtttatttctgctctgatctttatttcttttgttctactaattttgggtttgatttgctcttttctagttatttaagatgtattgttaggtggtttgtttgaagtttttctactttattgatgtaagcactttattggtatcaactttcctcttagtactgcttttgctgtatcccatatgttttggtatgtttgtgttcttcatttgtttcaaggaatttttcactttgctttttaatttcttcattgactggtctttcaggagcatgttgtttaatttccatatgtttgtatagtttccaaaattcttcctgttactgatttctagttttattccattgtggtcaggaaagatacttgatatgatttccatttttataaatttttttagacttgttttgtggtctatcatatagtctgtccttgagaatatttcatttgctcctcagcacttttaagatcttattgtatggtctctttgtcttaattttaaaaatgttggctgggcatggtggctcatgcctgtaatcccagcacttcgggaggccgacgtgggtgggtcacctgaggtcaggagtttgagatgagtctgactaacatggtgaaaccccgtctctactaaatccaaattaaaaaaacattatctgggtgtggtggtgcatgcctgtaattccagctacttgggaggctgaggcaggagaattgcttgaacctgggaggtggaggttgcagtgagccaagattgcaccactgaattccagtcaggcaacaagagtgaaactccatctcaaaaaaaaaaaaaagaaagaaagaaaatattattctcaattgttcctttgcaggtagtctgtattttttccctttaactttgaagattgttgttttgtctttggtgtttaatggtcatattataatgtatttagatataagcttatttgtattacaagttaagttagagaattaatgtcttttattaattttggaaattcttagccattacttttttgactagtgtttttttttctattctttaaaaaaatttattttgaaattatttaaacttatggaaaagtttaaagcatatatatatagaatggagtattatatatataatatatatattatatatatatataaaaagaagtgagcactaacacatactacaacatcgatgaaccttggaaaaggtacgataactgatagaagctagacaccaaagagcacatgttatattattctatttataggaaatgcctggaataggcaaatttatagagacagaaagtagatttgtggttgcctagatttgaggagcttaggggacaatcaagaatgatgaatgattatgagtttttttgggaggaggtgataaaaatgttccaaacttgaatgtgatggttgtgtggctttgtaagtataccaaaaaccagtgaattgtacactttacatgaggaattgtatggtagttgaattatatatcaaaagagctgttgttaaaagagaaaatagatcattatttcgtgttttttcacccttcttcccctaatattaacatcttgcttatataactataatacagttattgaaactaggaaattaatattggtgcagtgctgttaactgaattatggacatgtgtgtttaaaaatgtcctttttctgttccaggatcccatattgcatttcgttgtcacgtttctgtattagcccattttcatactgctgataaaaacatacccaagactgcgcaatttacaaaagaaagaggtttaattggacttacagttccatgtggctggggaagccttacagtcatggccttttcttctgccctaggagactttaattgtttgagaatagtgcaaagctctcttattagttcctcagtctcttggcctttgtccctgttatgcactgttttctttgtttgttttgttttgtttttgttgttgtttttgagacagagtctcactctgtagcccaggctcgagtgcagaggcgctgtcccagcccactgcaacctccgcctcctggtttcaagcgatttttgtgcgtggctggggcatatgcctccacgcctggctaatttttatacttttagtagagacagggtttcactgtgttggccaggctggtctcgaactcctgaccttaagtgatccacccacctcggcctcccaaagtgctgggattacaggcgtgagccaccacgccaggcccaaatgaatcttttaagaatagcttttaaattgttttgtatttcttaacttgaaatctctaaagcctaccttttcttttagatttggttccaactgctttgatattctaagtatgctgtgatctaccagcctttccccaccaatacttgtgctttttgtacctataacatgttgttttttgtttgacttttgctttccattttcttgtggcatggctgtgtgatttctgttcattctttcttcaaatctcttctcaggtcttatcatctcttgataccttccctgatgactcctacccattgacttattatcctccatagattcctcttgaaactattttctgttgaaatagtttaaagtcatatcatatacctttttgtttccaataatttagagtgatgtatctttttcttcctttacaataaggtgtcaagtttttgaaggattagatcatctttatattttgttgtttctgtgagtattatgtaccactctgggtatgcagttgtgctgaattgatagcttttagagaattggtttgggttttatttcaaatgctgatgatttataatatcagagttacttctttgtgtaaatgtgcctactgtcatgcctggtctacaatactgcccttaggaaaggttagttgaacccaaatcatgtaggggatcccaaatcaaagagcatttattattctactgtttcacaggaagtataaagtaagagcaaatgcactgaatccaagttttctcagaaatactctgtctactgtctttcctttgagcctcttcttaatctgtctccttaagtatatattactcatttatctttgacatttttcatttactaccttatgtagtttttctaaataatttatatttgtaggtagagataaattgtatgtgttaattacagcttaaaagaagagattggaatattttagaaagattaattcttattaaagactatctaattgatctgtgtttgcattcttcctatctgagtcttaacattttcataaaacatctatcagtgaaaaaatcatcagtgttagctggaattgaacttaagaagatatttgactacccataaaaccagatattgaatgaagaacacttggtttaagaaaattgggtcaagttagaaatgatacaacatttttgctgggctttagatttattttatcattaatgacctcttaaaaaaccggaattaacttttaagacatcttaaattattatgttaaatactgtagttattctcctacctctgaaaagcttgtaaggtgatttgagaatgtttgatttatatatattaatactccaattttctgagtggtgatattgtttcaacagggctgaaaaactaaaaaatgtggatacctggctttagaaatgggctagcattatcttacctgctttgtttcaggggctgattcttcaacaatgcatatagctagataatctggagttaattttgtgtgtgtcggtgggagtgagagcttgtgtgcttaggagagagttatttacttggttaactaaaaacgaagtagtaaaaaagcaattgtgtgaggcaggcataacttcaacagtttacactggtttaagttatttcatttgaggggtggtaccttattaagtcctatcttctaggcatagtcttatttgtttcttaagtttccttataataaaatatagtactcttaattaatggcttcatataggttggagtcttgttaggtgttgaccttttctatttgcttcacaggttgtttgcattcgctccacttggaatgctctctctccaaagctgagttgtgacacaagacctctcattctgaagacactgagtgaactattttctctagttccttccttaacggtcaatacaactgaatatgaggtatgcatttggagctcagcacattgcctgcttcttcatgggaaagatgtgtgttataataacttttggaataaatattcctaatctgttgttgttgttgttgttgttctgagaccatgttgatatgtttatggactcttaggagtaagatagctcctcatcaatcttatgtctaaaatgtatttacataaaggataccaacttttaattatgagagtattgtcaagattttaaagtcaatattgtaaaactagtgtttccaaaataatagaattcataaagccaaccattaaaaatcattttgttaatgttttaagttctaaaaaataagccacaaagacattaataaaggcaggacagactctccaaactttgtgaattactcagtgtttgtcattgtaatgagttgaaatacttggtggaagattcttttttgtaagattcatatattactgcttaatattttcttaattatctcttctttgagtgaaatgcatgagagggtagtgaattacatttatgcctctacatttgtaagccatactttttttttttcatgcttaccatttttccttttccttcaaagagcagcagttgattttcacttgcagtcttggtaaacttctagtttgatttagtccttcacagactttgataaactgccactccagccatcagattccaataatagtcctttatatgttttagatcatctgactgagacaggcttagaagatacttcaactcattctaaatgctgcacaatgaataaaatcaaatttatccttactgggctatacaatacctatcacagtacctggtgcataatctatatgtagtaagtagttgttgaatgaatgattgaatcgatacagaatattttagtttattcttacatgtagcctttttttagggtcttaaaaaaagaatcaatttgtgactgtgagtatacagttcaccaacattctttcttatggctgcagttcacaggcacttgctcttatattgtcagagagtccacagggctactgataatgagctaagactaaaagccaatgtaaggccatattgggtatatttactttctgtcttcagaggctaaaatcatatatcttttgtattgcttgtaccttgagttaatcagattttattacaggttaatttatgaattggctggtgtgttggttttttgtgttggcttatccatggttgtgaattatcttttggaccagatttttttttcttccagattttacattcttttcctttggtatcttatactagggttcctctgttgttcagacggactgctttggggccgttctctctatctcttcctgcccagttagggggagtctcttcagtgaacatagtccccttaaaagcagaagtgaagaaatgtagaagggagagaccctccttcctcctcccactttcatctgtgtgtgtttagataattggttttttaactacttagaatttgtctggatgtgagccaaagttgaatttaatttttcccagagtgcttcttaagtcatttctatccctagtaacttcattagcttaagtttccctaaaatgtagtccaacctgtttacaacaagtccataaagcattctggaatctggcctcattagtggtctgtatgctgcactccaataaaaccaaaccacttacagtgtccttcaaacttttccttcctccaaacttttccatttcttttcctttgttcatattattccctctatctaaaattactttctttttcctctttaatttaaaaatatattttaggaagaaaaggattgttttaactcatcccatcctttgagagtttgtctgcaagctggagtcttttgttcccaaagttctttatactgttctaagaacgtttattctattttatactacaggtatatgtatgcatatattattttccccattcaactataggcttattgaaaatggagtccatgatttaattatagtgtattttctgaattgctttgcacagtgcttgcttcacttattcattgaatcagaatatatttattaaaactgcgctaggtcttagagatactaataaatatagtcaaccctatttttgagtacctattcaatccccatcactcttactagtttataccaattagttctaatctctgataggaaggtatcattttttattgtattgttacagaaactaaacctttgagaggcctatttatttgacaaatatttatgagtatctgctatgttctaggcaagtaacttgaccaagactgtagttaaaaagctaagtgaaagctgatgtctgaatccaggactttctagtttcatatcctttgttttcgcattataccatgttatcagtccctgccttctagaagctcaaaggtaggtaaaggagatagatgtgagtgatgataattatagtaacatttgatgagcacagttaattaaagggcaatgagagtgtggtagagaaaatgacaaacactcttagcaagaatccaaggaaattatttgtgctattggacttggaactggaagaattaatatactgttgcttcccattgaagtttggggactagaatatgcaaaggcaaggaggtatagaggaacctaatatgatttagaggggcaaaaagttagatgtggtggcaatgaagaagaccaccgactgttggaaggtaaatggcttttatgcttaatcaattatttattacacatttgtcatctttgaggaactgtgtgggctctgtggtttaggtctttgaaatgaaaaaaacgcagtcactgccttaagtattgtacaacctcgagtgagttagtcatgctagatgtggaggtgtaccatgtgccgtatggccacatggagaaaggaaaactctcttctgggtaggctagaacagtggcatgaaagagtgacatttctgttagtacttgaagggactaagagtaagaaatggttaggtttctaaatttcattatcttaaaatcttaatgtgtttaaaatatccatgtgcttagaggatgagtttgtttctgaatatttacattttatgaatgatgggtgaatacacattaagtgaatttctggtggtgttactttaaaagtgacttaattttcattatttgctactttggattatttagtctcagttttagcttggtcttaacaatttattcttttgtatgttaacttttcagaattttaaagttcaagtcctcagcttcctctggactcatactcaaaacaaggtactatcacaaggcttgtcagtgaatcagaacaaagctaaggaaataattttgacatttgtaaaataagactcttaggataaaaagtacaactgccttgaaataatgggttcccaatttttaaaaaaagtgtgattattcataagttttggttttaaaaattatgctcaatttatgcccattaatacatttttaccataaagtgcacttaatacttggtgaatctgacagatgggaagaggaactgttgatattatcttatatttttatatggtctttcccctttcctgctttgccccttccccaccaacaagcataccaaacaaacaaaaagtccagtccattttttagatgttgtttccaatcaaggattatatatagagactgctggtgatgttatacctaactcatggatgaatgagcttagattccaaaaaggctaacttgccctattaataggtggagaatcggaatccaaacctaggcctatcagacagtaactccttgttctccttctgctaaatcatactacttcatggagacttgagcaattatgagttactttatatttaatgttcaaactaggataaaaatttagtatttttgatctccttgcccatttttaattgggcatattctccagaaaaatgtttaatgctgataattttttccagttgttcttacttcccttcacagaccctttcacttttttttgcaatattttgttttgaaacgaggattaaatttctcgatctctcttttgaaattgctagtaaatatccttttagctaggcaaagctttaataccattttcaaagcactgactgtagaactttgggattggtgagggaaggtttctttccccctccagatttgatgtttaatgcatgttgtgtttttttgtttgcttgctttttttttttttttttttttttttttttaccctatctaggacccaattgtagcaaatgctgcatatagatccctggccaactttactgcaggagaacacaccattcttcatctgcctgaaaaggtaggcatatctgctttctcactggtatttcttaatttgctagggtttacaactttttctctctcatcttaggagatacttacctgatgaatatatacataaccctagatctgttgtccatgcaagatacaaattcatacccattatttgtttatatgtaaaagactgtagaggtttgaagcagatggaagacacctatgatgcaaatgaaatcttcttaaggtgactgggtatatggcttgctccagatctgagtcactcatagggatcactttgcctaattagtatgccatcctggactttaatccaagcatggccttcatagactaagattttatagcacctgtgcagccaaagatctctatttgtgataaacaatgggatgccatatgaaaaaatctgcttttttttagtatctgtgaatggtatataggtagctccagaaaactggatggagaaagtatcactatcttttaagagttaacacatagtgtgatattcagttaggaaaagaggaagtcaaattgtccctgtttgcagatgacatgattgtatattatcttagtttttagactaaactaaaaacatataacctcttctagtatctgcctattataatcagctttaaattagtagatcctattaaggggttaaatatctgatttcttatttagtgccactatgaattcaaatgcatacagatgtttattgagtgcctctgaagtgtcaagcagacattgtgttagatgaagttacgtgtaacattactcagaatctgtctttgaagttacgtggcaagaaggtttggtgtgaattccttgggatcctcaggcattaaaatgggtttgcctttttcttctggattgcgtttatactgagattagatgccagtaggaaccaggcaaatttctgtttactgaattgaattggagccacgatataaaaaggattgaaaataggctgttgtaaaaccaattcctaaggcaggcaggatttcctgtgtcattgaggacttacaaagatagattgaccgcttgtcatgcagtgatcacaaatgggaaaacttaggtaaagatgtgttatgactcatacaattaaaaaagatgggacttcagactgcattatgatgaccagcaatacccattgttgctttaaaacaggaaagaaaaaggaaaaaagctacatgtaaatttcatatgcaaacacctgccaatagattagctacagcatctggagaggcaccttttattcttgtttttaataggcaattattcatttaaatcacagcataaaaattacccttatttttacctttcattcctaaaatattccagcttgagtaatagcttttattaaataactccagcatactcttgacatttagtctctactttttaaaatattgacatgcttatattttttttctgattttggatttatattcaatttccaattatgtttgcaagaatttataagtgctatactcagccaagtgttagctacttccttaatctaactcttctaaactctttgatccctgaatagccataaatagctctttatatcttccaacataaatggtaaacgtacttagagttggggttttctatatatgtttgggttttcagcatcagagtggaaagagctataaaggaaagctataaggcgtatccttttgtagctatgcttttcagctttttttttttcttgccctaatccccttctgggatatgacccattccaaaaagtaacaatagctcactgcagtggatattctgaactgaggttgagatgaggggtgtaagtggtttgaaagagtcttcctcactctgaccccagcttctgatactgaggacctatctctttatggagaatcattgcttctaagaccacaccatgcattcttcttcttttcattgattgctacatttcagtttggctgttcgaacacctaaagactaaaagtccagaaagtgttcaatgtgttcatatcccaaacaagttcccaaacatacagcctggtcggtgcttcaccttagttttgtagatgtgacactataaaacagtgatgtgaaactgcagctcatttttctataaaaatgtattttcaaatgttttggaagttcctgtcaagtgagacttctgtaatgtaaaaactaagattcttctttgttgacagacattactctgcactaagggcaattggtttacacacaagacttaaggttacctatttttccagtgaaagtgtgtccatattctctcttcttacctatggaaaccggtggaataaacttttgagcccattgtgaatttcaagtagagctaaaaaatatatatatataagatatccttacaaatgtggctactttgtgaattataattcagctactttttaaagtactgattttctttaaatttacttaaatatttcttgttgattgctgaacatcaatttatgttgtataacttgttgaaagttaacagactggtagaacaaaaagagtaagaggattggcagatatcagaacaaagatttagggttgaatgaaacagtacatttaaggtaatgtactggatagatggtagagctgaatgagatacaataatatgagttaagaatttgaataccatgttgatgaattcatctttcttgtcatttgttattaagaatttctgtgggattagaggtgatggacatgtaatacttgcattggtttaataataatttatttggtatatactaagtgctaggtccgatctgaagagctgaggatgttgactgaatgcatatattttgttggtttgtaacaggatcattgttaatcacttaaagcacacagatctaaaattggttccaaaatttcaggggacttctttgaggacatgttgattgtcatgttgaaagatagataagaatgatttttcccttttagcttttattttttctgattttataaaagctagttacacttcccctgtcttctttagcacacctccccaaaagaaaaaacaaacaaaaaaactatggagaagtttccttgttaaaagaatcagtaatggataaacatttaggtagaagatactgacttttctctctgacttggtttcattaaaaaacattcacctatttaaaaattaaacttgttttcttgatttctagggttaattttagaaataatataaaagaactgattatgcattcagggttggtataaatatggtgtaacccgtttggctttgatttaaagtgaatgtcactgcattcatcagaagctgtttctctttttaactgaataatttatgcagatacttgacatgttccaaataaaattctctgtttatgcacaaactcttggatttccataggttacagacacagaaagttgattgaaaggttatccggctcagaacccacagtgaggcattttgtgggatacactttccagtacagatggtccccaactacgatggttggacttaacgatttttcaactttatgatggtgcaaaagtgatacatattaggtagaaatggtacttcgaattttgaattttgatcttttctcaggctaggctaagatatgtggtaaaccactctcttgtgatgctaggcaacagcatcagatcgcagctcccaatcacactgaatcacaagggtaaacaactgatattctatagtgttctgtgttaccagatgtttctgcccatctgtaggctaatgtaagtgttctgagcacacttaaggtatgttaggctaagctatgatgtttgataggttaagtgtgttaaatgtatttttgtcttctgacattttcaacctacgatgggtttattgggacataacccccatcatgaatcaaggagtatctatattcaatttgaagcaagttttaaaagtaaattatcagctgagtgtggtggcttacacctgtaatcccagcactttgggaggccaaggcaggcagatcactagaggtcaggagtttgagaccagcctggccagcaaggtgaaaccccctctcaactaaaaatacaagaactagccgggagtggtggtgcggggcctgtaatcccagctactcgggaggctgaggtaggagaattgcttgaaccctggaggtggaggttgcagtgagctgagagcatgccactacactccagcccaggcaacagagcaagactctgtctcaaaaaaaaaacaaagtaaattatcatttttgactttccatttaagttttttaacaaagcttagttataataggcaggtcgtttttgttggtggggtgtgtgtgtgttttagtaggttggcacaaaagtaattgcagtttttttcttttgcgccaacctaatagatacatatgcagttttatttttctgagtgttttagcagctaatataatattattgccaaaattttataaccttaacaggaattctttcaactgagttctcttgattctctatagttttactcgcattgaccttattaaattgttgcacacaaccagggggaaagactggtagtagcctagggaaggtagaacaaataattcttttaagaagtgaccagaggagtaaagaacttactcatgtaaccaaacaccacctgttcccaaataacctatggaaataaaaaatttaaaaaaaaaaaccaaacaccgcatgttctcactcataggtgggaattgaacaatgagaacacgtggacacaggaaggagaacatcacactctggggactgttgtggggtggggggtggggggaggggtagcattaggagatatacctaatgctaaatgacgagttaatgggtgcagcacaccagcatggcacatgtatacatatgtaactaacctgcacattgtgcacatgtaccctaaaacttaaagtataataataataataaaataaaaaaaattaaaaaaaaaagaagtgatcagaggagaaaggaaatttaatggaaccaaaatgtaataaataataagtgctaatttgtccaggagaatcagctcacctattagaaaacaaaattgaaggagtgatcataccattataaatacatatagtatataatctattcttaaattataatacatttgtaatttctttgctaaaatttatgcacatttgagatgcagacatatgctattcactgcatagaagataaattaatatagcacacagttacgtgaatatgaaattagacaatttaagattgatgggttggtcagtttgctttatccgcaatctttctttagtggctcttaaaaatattgatgacccaggtgcagtgacttgtattaagtaattaggttgactgcacagaaggacaggataggaggataggataaaagttgtacagaaatgatcatatcccttttatactaaataattctggaagcatttggtcatttgacatagtttgcacagcactttaaggttcctctggtggtggcagtgacttttccccgactccccacccccccttactcttttcattctactcccctcctcttcccctccccctcctcctcttctgcatgcctacataccttcctccctccctctctccctccatagctccttccttccttcctttcttttctcttttcttttctttcttgcttgcttgcttgctttattgacatatgattcatatactgtacaacttaccctttaaagtatgcaatttagtggttttagtatattgaaacaattgtgcaactaatcacagagcaaccacaatctaattttagaacattttcccccctgaaagaaactctctcagcagtcagtctccattactccattccctctccaagacctaagcaaccactaatctgctttctgcctctgtaagtttgcttattctggacctttcctataaatggaagcatacaggatgtggtcttttgtgatgggctttcttcacttatcttagtgttttcaagattctttcatgtgtagcatgtatttgtactttattcctttttatggctggataatatttcatggtatggatttatactatattttgtttatatattccatcaattgatgaacgtttgggctgcatgaatgttttgaggctattataaataataattctatgaacatttgtatgcaagcttttgcatgatcatatattttcatttctcttggttatatacctaggagtgaaactcctaggccatgtagtaactctatttttttgttttgccacgttactatgatgtgtaaaatgtcaggaagcaaggcagaagaactcagaaccaacttctttctcaggactttttaggccactaggattgtttagaatctttaagacaactctcaaggagagtaaacctggaagactgtgagtatgcacacagactagacacttgaaaaaccctcctggtcagaatcaaaaggtttgcgaacatgccagagtttctctgatatgcagtgatttcgacagacgctttcataccctatctagagtatacctgatagttatctctgtaagtatggctgattccgccctctgagaattaggtacttaatactgaatctgaattaaatcttgtcttggacagtgctcgggtagtcaggttgctttcacttctccttcactagtgaagagaacactagttatggttgaaaggcttcattggagttgacattattattcttaagagaagcatttcttttctgtttcttctacccccctgcaagaatcctgagtcagtgcacttcctaaatggaacagtgctttggggacctatgaagaaggcagtctgcaggaattgttaattatttctaaaaataactctgggatacaggctaatggtgatgactggattctggcactttatggttatagaaaccacttttatatattttgatttcctcccctaatgcttaattatctccatgtggacattatgatagagtgtcattgaaggtattaaaaatgtaattaattgcttaacagttatatcttgtgaaaacaatgtggaaatctttttacatttttaatttttggttcaaacaaacctaactaatcaaagagcagccacaaaaatcctcaaaatgcaaattagacacaataatgtacagctaccaattacagattttagtgtttttgtattccacagcaacaaactgccaagtcttaaaaaaaaagaagtcaactaaagcattctgttgttccctgagctctactgtatattctactggaagattttaagctctgtcatggacatatgactagaatcacaaattttttaaaaagtgttcagacaaggcaaatatctaactatgagctatagaagttaaatatattgagtatgtcagtgtttgcattttatttttggatggtatagaattttattagttttctataataatcattgcttatactggcttacagtgatttactgtattaacataagctttttatacagatctgagattgtatctaataagatgactagagtcatgaccatttagttaatctaaaaaatgaatagatttttaaaaaattaatttcagtggtcttttatgttatagagtgatggagtctaacaaaattttaaaatcttgtcacaaaaaaggatacagaaaagattttgcataatgttttattattatcctctctatgatcttttcgcttatcatttcagataagaccagaaattcccattcctgaagagttagatgacgatgaagatgttgaggatgtggatctttcagttcctggctcttgctatctcaaactgttgtcactcactccccctttggttttaccaggtgactcctatttggtagtagagaagctagcattttttagtggttcgatttgtctgattgtattcttttgtgataggtacatagtatagtttaaccttatgtgcttattttttaaccagaatgttaaatgcacccatctgttctattgaaacagcttgaggtagtatggtgtttaaatcatacgaaaaaacgttacatctgagtaggattgaacaagaaaactagtgtaaacaattgtgttcactgataattaaaattcatttaaaaggctaaatgtattccacaagatgaatttgcactggtactctaggtcattgatttaaacaatacttctttcttacataagccaagtgaaaagatcattagactattcagagatttactgagtagtttcattattatacatttattctttctatagagttatgccaaagatgttactgatatttatttcagagctataaattaatgcttttaaaagatggatcaaattgtatggtcattcagctttgatgtaaagcttatagggcctttatcttttaaaaagtaggctgggtatgatggctcacgcctgtaatcccaacactttgggaggctgagagaggcagattgcttgaggtcaggagttaaatacaaaattagcctggtgtggtggtgcatgctgtagttccagctatttgggtggctgaggcacaagaatcacttgaagctgggaggtggaggttgcagggagctgggatcatgccactgcattccagcctaggtgacagcctaggtgacagcctaggtgtctcaaaaaaaaaaaaaagtattctaatgcttatatgtggtaattattctatatgtatattgtgtttagaagtactcacttgcccctattactatatgccctacccaagaaatggtagacgataccatttgaaaaatatgtttgattgtggactgtgattaggaacttacattattttattttgaatgttattttctgatcattaaaaagttatttacaaattcctcaagtgatttattgtgattaagtagcttttctatattagacaacatcttgcttagttttgttacaattctactttgaatgttcgtggatataaaaatttaatttctggaaatgaagttcaatcaaaacaagaaaggtcatgttattttctcagtcataaccatactagcctgtaatgttggaagttttttcctctggtttcatcccacatggaaattcctgtgaaattcagccaaatatatactatttatttctagacaaagctccttttacagttccctgcctccttttattagagaaaactgaatggccaagttagacaaagagatcaccttttctcttctcctgatatctagaaagaagcctcaaagacttgttcactcttcctctcttctgttcttccccacttcctacctcttagcttttcagagtctaaggcctccctgaagttaacatgagtccaaggaaggaaaaagccttcagttatccaaagttctttctttaacctgaaataacctagagtcagaagtcctttggggctttttaaatgatttttttttcacttgtacatgtatcccccatcacagtctctggtgttagaaagagaagtgggggaatatttgttgccaaggggtgctgttgtttgtcttctcagtacagaatgtgcagtgctatgatggctattacctggatcttctacattgtttgtccttggtggttctcagtgccttcgactgagaaagaaggggaagagttgagatcgacaactgtatttgtttgagaaaatttagtaatttgagtgaggtgggtgatctagatgctatgttggcaaactgtcaccatggacattttttcgttgattattagagaagtataaaaagtgtccctttgattattacagaactagaaaaagaaccaggaaaaagtcaccagccttaggaatatataccctaaaatgcacaggatgaatgatatatattagtcaccaaatgctacagacagaaaagtgggttgtgctgaatttaagtgaatcctgcccctttctccttttaattcctttcaaatgaacacaaaagcagctgtaaagtgaatccaggaatttgcattatttaaatagagatgttactgctattgattattaaaaaatagttttgaaataattttacacttccaagaagttgcaaaaacagtttagagagttctgtgtaccttttttgacctggtgctctagttgataacatctcacataaccatagtatgatattaaaaccagaaaattgacattggcacaatattactaacttaaactatagaccgatgtgaattttatagggttttctcccccagtatataaacttaagggattagctatttctttccccgtcaagtgtccttgaggggtttgggccatcaccctgaaagaccaaatcccgaatagcataattgtaattgccgaaatcctgaaagattaaaatatctaaagtctaaaatcctcaaaatcacaattctgaaatctcaaaaatgtaattctagaaaaataataaaatgttctttaaaagatgtttatttacattttaaaaggcaatttacttgagaaacataaaaacacagcagagcacttcatagatcactttacacaataaaataggcaaagtaatgtacatatttttgcaatcataaacaggtatactaacaacagccacaatctaacaattatgagcagatgaactgtattcataaacaaatagccctcaaaacaatatgtataaatgcttatcactatgactggtggttgtgggctcccaggtttgtaactgcagtcaccggaaatactctgatgcacaactgaagtcttttgacaaaatcattcgaaaacctcaagctcgagaccagcctggccaacatggtgaaaccctgcctctaccaaaaatacaaaaattagccgggcatggtggcagacacctgtaattccagctacttgggaggctgagacgagagagtcgcttgaacctggggcagaggttgcagtaagccaacattgcaccactgcactccagtctgggcaacagagagactccatctcaaaaaaacaaacaaacaaacaaaaaccccaacgggttaccactctttatgcagtcactcaaagaattgagatctcgagatattttatgtttcacaaatgcagatatacaaaaatgacatctctacttattgtggaagtttcaacatttttacatacatacacaatacttacacacaaagtcagtgttgtgataatgcacttttgtggagtcatatttgtaaaaaaaaaaatgcataaaaccaattagaactctttagaagtctttatacaatttgtacttccagtatcggaaaagatgcaaaaatgaaatacatagcatagcaagttggcactatgtgtgaaggggcggaagttgtacatgattaaataatttggcaggggagatttcttgtgttttttgcctgcgttttcatttctgtgatcttcaaaatgtgaactgtacttgtatttggagagtggttgtggtctagaaatttggtgagtatatattctccatctgaaagtctagttattgctcggccattggaaataagcaattttctgcttttgctgcatcaataataattaactttcgaacttctttcaccattaagtagccttgtacacataacttatcacaaccccttttcgtgagagaacaatttcgcatatctcttccactctgttgtaaggaatatagtaagaaggaattgtatttggcttctccaataccaaatctattttagtcacatttcttctgaaagacagaatcaataggacatgtatatagatatatgaggggaccgattaggataattggcttacatgattacagtagctaagttgtgtgacagactatctgcaagctggagactgggattctggtagtgtggctccattcaagtccgaaggcttcagaacctgggaagtgggtggtgtaactctcaatctgaggccaaaagcctcaggacccagggggctgctggtgaaagtcctgtagtttaaaggctgttgagcctggagttctgatgtccaaaagcagcagcagaagcctgtcccagctctcatagagagttcaccttctgcatttgttctctctgggtctctggacaattggatggtgcccatcaacattgagggcagatctcccctgtacactactcagactcacatactaatctcctctggaaataccctcacaacccccaaccccaaataatgctttaccaggtttctaggtattccttaagccagccaagttgacacttaagttcacaagttcaccccttgtcaactggcacccatacacatctccttaacttccaaataaagacagtaacaaggtaatagttctgcctaacagatgcaactatcctgtgtacaactgaaaatgcactaattccctccccaggattaggctttcaggatttcaacatttgggattttaaccttttgggattgtgattttggggattttagatgttaggaagtttagacttaagggattttgatcttccagaatttcagcatttgggattatggtgtgtgggactgtgtcttttgggattattattagcactagttttttatatttattccaaatagttacctgtatcaattgttttttcttttttattgctgactggcattccattgtgtgaatgtaacacagtttgttgatccattcagctgttgaggacatttgggttgttttgagaatttatgtctgacactttgtgtcctacgaattttcagcttctttttaaattcccatctggtcattggtaagaaagagattggggaaagctcaaaagcaacgagaaaaattctagttgctaacttagtatttacgggaagatgaagctctatacatcaactacacttagcctcctggcatcttatcctcatttaaattaatccctgggctggtgttaggtaaacatctgtagttcactgtagagcttggtaagtagaaaacttccattgctgggttagtctatgtgcagatatgttcttgccccttgacatgtttcaccttttgccagaataggatccttctgagaaaggaagaaattactttctttcatcatagtgcctctaccctcacaaacagttgattcatagctgcattctgtaaagtctataattatacccactttgaagcagtccctgtgtatgtgtatgcagaaattggggtacatggcctgcaatcggatattactcatctgttttgtgtaaatgatgtattgatcactgttatgacaagaaagggtgggggatacattcagattgagtaattggagagagtttaataaagaacctatttacagttgtgttgtcaaggttaagggaaactcacaagagatggtaaaccgtctcagagtgcttaatgtctctggcctacagagataacgggaggaagaagaaagagtatctgtattataaattggggtgcctaaggggagccaagactttcagaagaggaatgcaggcaacctgtagcaatcctgcaagaagccctgtgtctggggaatacatctcctgacttcactgttttcaccctttgatgtcctgccagtgactccagtggttgaaaccaaccagaagccagaggacatgggagcctgttaatgcctttctttaaagactgtttttccagagcacagagcagggttgagaaggatagaggatagataagaaggagtaaatggaaaacgtcacatattggtgtttttgagctttgaatggagaatcttgattgcatctaggagggtcctgtcagaaatgggtatataatagacggtccagtgagctcttgctgcctttaatttaatcatattcatttaaaggagacttttagatagatctcttcagaatgaaattccagttaggtggacccttgctttttgtttctgtaagagccacatgcagtggttttcttttttcattttccgctacatatgatttgtttagctttaatgttttttgtttttttgtttgtttctgtattgggcaacctctagtggtccttaggaaaatcacatttgaatatgaacctatagtcttatcaaatattttgtttatacatcctgttgtcttctgacatcatatttctgttattatatagtaagtaaaatgtcaaatgataaagatcttgggcttaattagaaagaacacaagcaaagatagtggacaaatatctcattttaaaataattgtcctaatattgctaagtatagatagttatgaaagaggtttttctgaaaacacttaaatgataagaaggagccattctcatgaaaatgtgggactgatatgttccaggtggaagggatagcaaatgcagtggcactgacttaaatatcaactttgtgtttttgaggaatggaaagaggccatatgtaagtgtgacttcaacatagcaaggaggtagggtattagacattaactctgagggggagtcagggctagattataaaaggtcttgatcatggtcagaagttgtgattttattttatgcacagtgaaaagcaactggaaggtgttagggacaggaatgacaaaattctggcctctgggcagaggaaggtttatagaggatggtcaagaggaaaagaattcagtaaactagtttttacattagtttgtatgaggaggacaaaagataataagtagataaatagcagtgaaaaatggagagaaactgatggatttgggatagattttgaaggtggaatcagaaggacttgctaatggattacatgtaataagtgagggaaagagaggaattaagcttgagcaacttggtgccatgttctaatttggaggaagactaagaaagggataggtatcaagaggtctctttttaccatgtaaggtttggccagaaatgtagcttagttgtttgtatatgagttaagaacgcatgtttctcttctagcttattgtatttactctacttttggtctccttttatcctcttttagctttggaggaattttttacatcacttgtgaagcaagaaatggtgaatatgcctcgtgggatatatcactctgcattaaaaggaggtgcccgctcagaccaaggaaagactgtagcaggaatccccaattttatattgaaaatgtatgaaacaaacaagcaaccaggactgaaacctggccttgcaggtaagggtagtacatagtatcaaaaatacaggtttttcatgtaatgatttaacttccactttcaagtaggatataatgggccatggcagggtgttgctgctgctactaacatgtggataaattataaaaatcatcgcactttaaaagacatcgcagaactgtagaagcaaagacaaatagatggatttaagtttcagagtcagcataacattttagaactgttttctccccaccttgggggatacccactcagcccagaggcatggcctgttggaagaaagagaaactagaggagcttttagtgattgcctgggactagggcgacaaattagagatttttctcacaggacatttgctgaattttgaatttgcaccaagagctaaagagctaggctgaaagcttctgaaaggcaaagtgaaatcccttttagtcttctgatgcttaggaaacaaagacgagctaggagaatgggcttgaaaaaacagcatgcaagaggtaaaagcccaagagagaatggtgaattgatactgaagatctgcaactgctctcacctgggtgaacttactaattctggccacagctggaatctgagcattcagcctcaactttattgagaagctggtgaggaggtggagaaaccagcagacatcttggcaatcatgtggagcaagagtgacacaactcagaacttgagtgaccttgagcacaaggccaatttctctcaagttatttgcgacattttgaagctttatgggatggaaagctaaagagctaagctgaaaatttctgagagcagacctaaatctctcataattttttcagattgaggagtcaaagactcattagactgccaattagtggggggtgttgtggggagatataccctggcaaaggagtgaaccagagctggactcaaattacaaaagttataatcagtcctaacccagatcaattcctgattaggttgaggtaatcagtccttcacccagtctgcctaacagaggagagaggaaaactactctttgattgacaataacaccatttagtacttctgtggttctttcatatactgcactagacacaggacaaaggaagaagctggaaatgaagggaatgattcctggagataaagaagtcactctctttggaaaatatcaattctaactggcctacatgaaataacatactttcaaaatatatgacaaaaatgagtagaactaaaagaggaaatagacaaacccacaataataatggaaactttaaaatatctttttcagtagctggcagagcaaggagacaagaaaatctataagatcacaaaatatctgaacaatctatgaacaaactactgtatagacatgtagaacattgtaccttatagtgatagaatttatatatcttttaactgtacatggaaaatttaccaaaatgaccatacgctggaccacaaacttcaataaatttcaagatattgaagtcacttagagtttgtcctctgatgacaatgggattaagctagaaataaataacaaaaatgattaccatgatatctccagttggctgaaaattgaacagtatacttataagtaatggatggatcagagaaaagaatcaaaatggaaatgagaagatagtttgaagtgaatgataatgaagataagccatataacaacctgtaggttgcagctaaaatagtatttttaaacactgtttcccctctagggaaattcacactttcaatgtatattttagaaaagaaaggaaaataatcagtatttaaacttccaactcaagaagcttggaaaagaacagcaaatcaaacttaaaggatcagggaagaaataataaagataataaaactcagtgcaataaaaaacataaataagctggaggttcagctgagagcttaactgaccgttgtggaaagggcagggagaagagggagagtgagtgtatgtgaatacaggaatgagggaaagcttgtccacttttgagtataaactaaagggacccatgttatcatgtgttcatgaagattaatatgtgcaagtatttctctttaattgaaatttttaaaaaacttaatagaatctctagaactaaacagttcacaaagtcaagacttgcaaatttgttcatttatttatacttatacttatttactcataagtaaattgtaaataatattttacatgtgatcttaactaaaaagctatgagtcaataagtaatatactatattatattacgtttatattttgagacagagtttctcttggttgcccaggctggagtacagtggcacaatctcagttcactgcaacctccactgctagttcaagtggttctcctgcttcagcctcccgagtagctgggatttcaggtgttcgccaccatgcctggctaatttttgcgtttttagtagagatggggtttcaccatgttgacctggctggtctcaaactcctgacctcaagtgatctgcctaccttggcctcccaaagtgctgggattacaggtgtgagccaccgtgcctgtcccaatagtattttaaatattagctttttaaatctcttgtgtttttttattccttatatataaatggtcaaaaatcataatttgcttaacaagttagcttttagttataaatatctctatccagattgattatcagttactgagaatctaattagtaaagtttttccataagaaatgtctttgtaagctgggcgcggtggctcacacctgtaatcccagcgctttgggaggatgaggcaggcggatcatgaggtcagcagttagagaccagcctggccaatatggtgaaaccctgtctccactaaacttaaaaaattagccgggcatggtggcacacgcttgtagtcccagctactcaggaggctgaggcagaagaatcccttgaacccaggcggcggaggttgcagtgagctgagattgcaccactgcactccagcctgggcaacagagtgagattctgtcttaaaaaaataaaaataaaaataaaataaagtctatataattttttttaaaggtggtatgttattttgctatgatgtttccatgtatcagagtaaagatggaaaaccattgaacagactgatggccagcagagggcgaagtttcaagcagacttcacttgctcttgtacatgaggtaggttcccgtgtcctcttctttatgttttagtgttttctcccttcatgatatgtttaagaagttgtttgtttagaaataatttttttgatcataattaatgtaagttgcttttaaaggccaccaaaatagttgacccaactgaatactcaaatatttcaatgtatttctgaaagaaactgccatgttttcccccactgcccagcgtatttattagggagtaatgtctaggaatttgctttacttcatcaatgcttaactgtcattattcagaataaatatcaatttattgtttaaagaaatgctactgcctatatcttaattctaatcctttgcaattatgtaggggaccagtgtttgtattttgtgagtgtttggaattaaaagtaaataaaagcattttagaaaaataacccttggttttaatgtttattttacttttcctttcagctaccttttaaaaataaagttctgtgattctattagatgatttatatgaaatctgattattgcagattatggcaaaaccaggggaagagggaagctggaaagtccttgggaaatgtatttttattgtttttaaatattttatcacacttactcatatgatgtatacaaattaaaatgtatgaatgaataacaaaacaaaatgtcacagcaaagagatttatatagttcagacatagtaggttatatatcagttataagtaaaaatatatgaattgtaaagatttaatgaacttgatgtaaaaataattagcatttctaaaatatctttctataacatcttattttgatgcctaatttatacatttggttgtaattaatttgattcacttttattctgtatcacaccaattgccaccagtttcatagcacagcaaaattcagagggtttttcaagacccatctttgtcctttgccatccattttcctttcatatatttagttagaattaaaattgtgtaaatacttgtttcagaagctttttttttgcctaatatagtgtcttcattcaactaaaaagagaagaaggatctgggaagagcaacgcttttctaggaggaaggtttaatttcagacataggtgatttctatgttttttttgtccctggcatctcattagttggcatagagaagggagaaacgtggtacctttttgtgttttaagctgtgcacttagatatttgaaggaaaactgaagtctaaagtcttactgaaaagctgatttataataaaaagtcaccatcagaacagaaacaagaaaaagcattagtgcaggggatggcagaagacatctgataacttttggcagtggcatcagaagttatgaggtgtgtccgagatataagcacagaaaatctttgggttaagatacttgttgcttgtgctgtagagagtctagaaaatttcaaagggaaaagaaaataacatcattgttttaggggtcaattagaaggcgtattggacagaattctgccaaatgtatagtaggattttagactggattccatattctgctcagtatatgtagttcatttgcttaaaacacaaaggctgggggacccatgaagtttctcaaactatgtgacaagaaataatatgaactttcagagctggttaataaaaataattgcaataataacagctaataatcgatttagatactttcaacactgtgaggtaggtgctgttaatgtgtcaaggtcacatagctaacaagtagaggagcctggaaattgaacccaggcagtgaggctccatagtccttgaactgtcatcttctctcccaggttaatcagagaagattctagaaatacatttggatttttccaagattactctaagctctcttaaatcatctccttgcatcttgtctttcttttgttgcaatcaatttgggatttttccagatgaaatttcttcaaaccctgcttttgatcctcccattactttatcctgagtcttttttatttccaagtatttcttctttctttcctttttctttctctttttttttttgagatgaagtctcactctgctgtccaggctggagtgcaatggtgcaatctcggctcactgcaacctctgcctcctgggttcaagggattctcctgcctcagcctcccgagtagctgggattacaggcatgcgccaccacgcccagctaatttttgtatttttagtagagatggagttttaccatgttggccaggctgatctcgaactcctgacctcaggtgatccacttgcctcggcctcccaaagtgctgggattacaggcatgagccactgtgcccagccatatttccaagtatttcttgagaattgcagtttgtttattaattcaccagttgatggaccttcgggttttttctgttttcaatgattaagactaaagtttctataaacattctcatacagatccctgtgtgaacattcatttttctgtttcttttcagtaaacaaatacctaggagtgagagtgcaacgtcatgtggtaaattcatatataactttataggaaactatcaaactgttttcctagtggctgtcttattttgaatgcccatctgcaaggtatgagagtttcagttgctctgccttcttgtcagtgcttgatatagtcaattaaaaaaatttagctattcttgtagatgagtagtattagtttccctttgtggttttaatttgtgtttccttaataactaatgatgttgaagcatcttttcatgtgtttattttgtatgtatctgttttcttcctgaagtgtttgctctgatcttctgcccatttttagaattggggcttttgttttcaaaagagtgttctttatatattctggatattttttttttttttacttagtgtgttacatgtcttttcattttctttttttttttttcttctttttttttttttttttgagatggagtcttgctctgttgcccaggcgggagtgcagtggtgcgatctcagctcactacaacctccgcctcctgggctcaagcgattctcccacctcagtctcctaaatagctgggattgcaggtgtgcaccaccatgcccggctaatttttgtatttttagtagagacggggtttcaccatgttggtcaggctggtctcaaactcctgacctcatgatccatctgccttggcttcccaaagtgctggaattacaggcgtgagccactgcgcctggccttcatttttttataatgtattttgaagagtggacttttcattttgaagaatttcaacttaccaaattttacaaaatggttcttgctttttgtttaatccgagattacaaaaatttttcattttcttttttcctgtgttttatttttattcttttaaattacttttagaaattgaggtatggtatggtttggctacgtccccatccaaacctcatcttgaaatgtaatgcctacatgttgcggtaggaacccagtgggaggtgactgaattatgggggcgggtctttcctgcactgttctcatgatagtgaatgagtctcatgagatctgatggttttaaaaacgtgagtttccctgcacaccctctctctttgcctactgccatccatttaagatgtgactcgctcctccttgctttctgccatgattttgaggcctctgcagctatgtagaactgtaagcttattaaacctgtttcttgtgcaaattacccagtcttgggtatgtctttatcagcagtgtgaaagtggactgatacaaggtgtgatacatataccataaaatttacttatttaaagtatacaactcagtggttttcagtgtatccacagagttgtgtaaccattcccacaaacaattttagaacaatttcattacccagaaaagaaactgtgtacccatttgtagtcactcttcattttcccttgtccttagctttcagcagccactaatctactttctgcctctgtagatttgcctattctggacatttcatataaataccatcatacaatacatggtttttaatgtctggcttctttcacttagtataatgttttcagggattttccatgttgtagcatgtattagtacttcattcttttttgtgtgagaataatacttctctgcatggatataccacatttaatttatccatctttcagctaatggatctccttctgtgttttcttgtagaagttttacattttaaggtttactttttagcttaggtccatttgagttaatttttgtataatgtatgtgttatttgttgaaaataccatcttttattcactgaattacctaggcacttctgcaaaaatcacttgcccatatatgtttgggtctatttctgtactcacttttgttccattgagatctgtagatttgtgctttcaccgcaatgacatacatagctgaataactttcgctttataatgtcttgaaatcaagtagtatgagtcttccaactttgtttcatgtttcaaaaaaagttctgactatgctagatctcttgcttttctatatgaattttaaaccagttttaagaaaccacaaaaaagtttgctgatttcaatggtaaatgcattgaatttgtaggtcaacttgagagaggactgacatcttggtaatagagtatctagacccatgaacaaggtataattgtctatgttgattttttttgtattataaatcttggacatattttgttaaagttcgtaagtattacatatccctaagtattttgatgctattcaaattggactttttattttaattttttactgtttattgctagtttataatcatccaattgattttttctatgaccttactaaaccaacttatatattcttacagtctttttgtaaattatttttgtttttcactgtaatgttgtctataaataaagatgcttttaatttttgcttttctgatctgtatgcctgtcaattgtttttattgctggactgcactatctagggccatcattacagtgttgaataggactgatgagagttaatattcttgtctcgttcacttaggggaaaatattcagtgtttccctgtttaatatgatgtttatatacagattttgtcgacttcctttgtcaggttgaagaagtttccttctagtcctagatttctgagaggtttttttttttttttaatcacaaatagatgttaaattttgtaaaatgctttttctgtatcaattgagatgattcaacgcttttaaaatttgttgatatgattacttattttgattgattttctaatgtaaaccaaccttgcattcctgggatacactccgcttgatcatagcctatttatatattgcttcattctgtgtgctaaaattttgttaataaggatttttgcatctgtgctcatgagacatgttgttctgtagttttcttgtagtaattttgcctggttgtgttatcagggtaattttgtccaaataaagcaagttgtgtagagttcccctcttttttatttcccgaaatagtttgtatagaattgttattaatttttccttaaatgttgggtagaattctccagtgaaagcatcttggcatggagttttctttataggactgtttgtaactgtgaattccatttatttagtatacatgaggctatttttttttaatctacctatctgtgtatctacctacagacacacctcattttgttgcactttgcagatactgcattttttacaaattgaaggttcgtggcagccctgtattgagcaattatctaggcaccatttttccaataccatatgcttacttcatgtctctgtgtcacattttgctaacaaaatgtgaaatatttcttttttatcatcatgtctgttgtgatgatctatgattaatgatctttgaagttacgattgtaattgttttgaggtataacaaactgtgcccacatagcaccatgaacttcataaatgttgtgtgattttttatttcttcaccaaccagatgtccccccaattgggcctccctattctctgagacacaacaatattgaaattaggccaattaataactacaatggcctctaattgttcaaatgaaaggaagagttacatatctaccacttgaaaccaaaagctagaaatgattaagattagcgaggaaggcatattgaaagctgagataggctgaaagctaggcttcttgcaccaaacagccaattttgaatgcaaagaaaaggttcttgaaggaaattaaatgtgctactccagtgaacacatgagtgataagaaagcaaaacagccttattgctgatttagagaaacttttagtggtttggataaaggaacgaaccaaccataacattcccttaagccaaagtctaatctagaggaagactctaacactctttaattctgtgaaggctaagagaggtgaggaaactgcagaagaaaagtttgaaggtagcagaggttggttcctgaggtgtaaggaaagaagcgattttcacaacaccaaagtgcaagttgaagcagcaagtgctgatgtaaaagctgcagcaagttatccagaagatctagctaggatcattgatgaagatggctaaactaaccaacacattttcaatgtaggtgaaagagctgtctattggcagaagatgccttgtagaaattttatagctgaagagaagtcagtgcctgaaggacaggctggctgtcttgttagggtctaatgcagctgatgacttaagttgaagccagttcaactttacttaaaattctgaaaatctgagtgctctaaagaattacgctgaatctcttctgtgttctagaaatgggacaaggcctggatgacagcatatctgtttatacatggtttactgaatattttaatcccacattaagaactactgcttagaaaaaaaaagattcctttcaaagtattactgctaactgacaatgcacctagtcacccaataggtctgatggaggtgttcaaggagatggagttgttgttatgactgccaacacaacatccattctgcagcccatggatcaaggagtaattttgactttcaagtcttatttgagaaatgcattttgtaaggctatagctggcatagatagtgattcctctgttggatctgggagaaataaattgaaaaccttctggaaaggatttaccatgtagatgtcattaagaacatccgtgatttatatgaagaggtcaagatatcaatgttaaccagtatttataagaaattgattccagccctcttggatgaccttgaggggttcaagatttcggtggaggaagtcactgcagatgtgggaggggtaccaagagaagtagaattagaagtagagcctgaggatgtgactgaactgctaccgtcatgaggagttgcttcttagggatgaacagagtggtttcttgagatggaatctactcctggtgaagatgctgtgaacatgttgaactgacaatgcaggatttacaatattacataaacgtacctgataatgtggtatcaatgtttgagaggattgattccaccttagagagaagttctatggatgaagctatcaaacagcattgcatgatacagagaaatcttttgtgaaaggaaacattaagcaatggagcaaacttcattgttatcttaagaaattgacacagccatcccaacattcatcagccaccctaatcagttagcaaccatcaacatccaggcaagaccttccactcacaaaaatattaggagttgccaaagatttatataattatttacattttttagcagtcaaatatttaaaaaaaaatttttagtgataggacctcactatgttgcccaggctggagtgcagtgactatccacaggtgcagttacagaacactacagcctccaactcctgggcccaagggatccttccatctcagtctcttgagtagctgggactacgggtatgtgccaccatgcccagcagtaacaaagtattttaaaactaaggtatgtacattgttttttttaaatacataatgctgttacataatagattatagtatagtgtaagcataacttttatatccactgggaaacaaaaaaaactgtatgactctctttattggattattagctttaatgcatttgtctgggaccaaacctgtctgaggtgtgcctgtacttcctgtgtacatatagtgggatagttttccttttccaaaaatgctactattaaattagtgataaatctaatgattgcggtggtcttactaagaaataggatcttactggcatgtgaataagcccttatgtactgtttgtgttgttattcatttctattaataacagcccctaaagaatccatatccttacaggatattctatacccttcacaatggctacaactacatgagagtgagtgagcgagtgaataaatggctaaaagaactttattttgaatttagatgtgctctgtcctcatttgtaaaaacagactttattttttagagcagttttaggttcacagcaaaattgagagcaatgtatggagcattcccatacaactccctgctcactctgccctcatgcctacctctcatcttcccattatcccccaccagagtggtatatttgttacaaataatgaacctacattgacacattcttgttacccaaagtctatagtttatattagggtttattcttggtgttaaacattctatgggtttgaacaaatgcatagtggcatgcatataatcatataatcattttagtatcatacacagtagttttgctttctaaaacccttctgcaatctcccattcatcccttccttctctctaactccgtgtgaccactgatctttttactgtctctatagttttgccttttccagaatgtcaagtagttggaatcatacggtatatagatttttcagactggctgatttcacttagtattaggcatttgttttctgcatgtattttcgttgcttgacagctgacttctttttagtgttgaataaaaatccattgtctagaaatactacagttgatgtatccatttacctacagaaggatattttggttgcttccaagttttagcaaatatgtataaaactactttaaacatctttgtgcagaattttgtttgaagataattttcaactctcgggtaaatgccaaggagcacacttgctggattgtatggtaagagtgtgtttggttttggtaaaaaatggccaaaacatcttccaaagtggctataccatttcgcatctccttcctcttgctccaaagccttgtcagcaattggtgttgtggtctggattttggccattctcattggtgtgtagaataacatttcattgttattttaattcgcatatccctgatatgtgaagcattttgtatatgcttattttttatctgtgtgtctatttctttggcccattttaaaatctggttgttaggtttttcatagttgagttttaagacttttttcgtatattttggataatagtcctttatcagatctgccttttgcaaatattttcttagagtctatggcttatctattctcttgacagtgccttttgtagatcagaagatttttattttaatgaagtccagcatatccattgtttatttaatacatagtgcctttgatattgtttctgaaaagctgtcatcaagcctaacattatagatattatcctgtgttatcttctaggaatgttacagtactgtgttttacgttgatatctataatctattttgagttaatttttatgaagagtgtaaagtcagggtctagattctttttattttgcatcaagatatctggttgtttctgtatcatttgttgagaagattatcctttctccattgtttgactcattctcaaatattaacggactacatttatatacgtctgtttctggactttctattctgtttctttgatctatttctctcgtcatttgctcataccatgctgtcttgattactgtagctctatagtaagtcttggagttaggtatgtcagtcctccaactttgctcttcttcagtattttgttggctcttctttgtcctttgtctcttcatatgaacatttgaatcaatttgttgttatccaggaagcaacttggtgagattttgagtgtgattgcattgaatgtatagatgaagttaggaagaactgacatcctgacaatattgagctttcaaaaatccatgaacctggaatatttctctatttatttcattcattattgatttctttcattagaattttgtaatttttctcctatagatattatatacacacacatatatatatgtctgcgcatatatatgtgtatatatatagatatatttatttatgtaggtttatacataagtatttcatttctggaggtgttaatgtaaacgctattgtgtttttaatttcagcttctatttttttcattgctgtcatataggaaagcaattgatttttgtattgtaaccttgtatcttgcaattttgctataagtgcttatgggttccaggagttttttgtcaactttttcagattttctatatagacactcatgtcatctgcaagcaaagacaattttctttctttcttcccttcagcatacattttactttctctttttggcttacatcagtagaaaggatttccagtatgatgttgaaaaagaatagtgagagaggacatccttgccttgctcctgatcttagtgggaatgcttgtagtttctcaaaattatgatgttaacggtgggtgttttgtagatattcttatcaagttgaggaagttctttatttctagtttactgagagtttttatcatgaaaaactgttcgattttgtcaaatgctttttctgcatctattgatatgattatgtgatttttcttctttaccctgttgatatgtgggaataaacattaattgattttctaatattgatttagtcttgtgtaccaaaatccatgtggttgtggtgtataattcttttttacattgttagatttaatttgcgtatattttgttgaggccttttacatttatgttcatgaaagatattgctgtgagatttcctattcttgttaatacctttgtctagttttaattttagggtaatgctgacctcatataatgagttaggaagtattctctctgcttctgccttctgaaagagactgttgggaattggtgtgatatcctccttaaatgtttggtagagttcaccagtgaacacatgtgggagtggtgctttctgtgttggaaggttattaattgtcaattcaatttctttaatagatacaggcctattcaaataatatatctttttttcatgtgagttttagcagattgtgtctttcagggaatgaattggcccatttcatctaggttatcaaatttgtgggcatagagttatatatattatttccttattatcctttcagtggccagagagtctgtagtgatatcccgtctttcactgctgatgttaatttctaaatttgttgaatttgttaaggtctgtgttatggttcttttaaatttgttaaggtgtgttttatggttcagaatgtggtcagtattggtgaatgttacatgtgagcttgagaagaatttgtgttctgctgccgttgcataaaatagcctgtagatgtcagttatatccagttgattgatggtgtttttgagttcaactgtgtctttactgcttttctgcttgttggatctgtccatttctgagagagaagtgttgaagtctctggctatacgagtggattaatctgtttcttcttgcagttctatcaggttttgccttatatattttgatgctttgttattaggtgcatgcactctaaggattgttatgtcttcttcgagaattgacccatttattatataatgtccctctttattcttgacagctttccttgttgtcaagtctgctctgtctgaaattaatataggtcttcctgctttcttttgattaatgttagcatagtgtctttctctatccatttacgttttatctgtatgtgtctttacattaaagtagatttcttgtagacaacatgtagttgggtcttggtttttgatctactttgacaatcttaatttgcttccaaaatgattattgatatattttgattaatatcttctatatttgttactgttttttttttctgtttgttgctcatgttctttattctgcttttgtattctttttttgtccttacggtttcaactgaacattttgtatgattttttctcttttgttagcatatcagttatgtttctctttttactttttaaatgattgccacacagtatgcaatatatatttacaactatgtctacttgcaaacaacactataccacttcacaggtagtgcaaatactttataataacaaataatcctaatttttttctctcattccttgtatcattgctgtcattcatttcacttatacataagcatatataatcaaatacatgactactattattatttttaacaagctgttatctgttagatcaattaagaataggaaaataaaagttttatttcatgttcacttatccctcctctgatgccttcctttctttatctagatctgagcttctgatctctataatttgcttactccctaaaaaaactttaaacatttcctgcaagggaaatgtacgggtaacagattttctcaaattttgcttgtctgagcaaggctttatttctcctttatttttgaaggatcattttgtggggtacagaattctaggttgtaattttcctctctcagcactttatttcactctcttctcttcttgcttgcatgttttctggtagaaagatggatataacacttatctttgcttctctatatgtatggtatctttccctctggcttttttcagaatttaaaaaaatcattgcttttatgtagtttaaatacaatatacaaatacctataggtttttggcatttatcctacctggtgttgtctgagcctcctataactgtggtttgatgtctgacattaatttgggagcatctcaagatgatttcaaacatttcttctgttttttttttctcgcttatttgtctggaattcctattatgtgtatgttataacttttgtagttgtcccacggttcttagatattctgttttctttgctttattctttttcctcttcgctttttagttttagaggtttccattgagatatcctcaagatcagagattatctcctcagttgtgtccagtctgttaataagctcattaaaagcattcttcatttctgttaccatgcttttcgtctctagcatttattattttggtttttatatctctctgcttacattgttaatttgttcttgcatattgtctttattatcttttatggcctttagcacattagtcatggttactttaaattcccggtctgttaattccagcatccctgcttatccttacttggttctgatatgtgctctgtctctttaagctatgtattttaccttttagtcttccttgtagttgtctcttgataaccagacataacatactaggtaaaaggaaataaagtaaataggtctttagtaatgtagtggtaaggtgttgggggagtagagtcattccataaccctataattaggtctcaatctcatagtgagcctagaactttcacaagtgtttctcaggatttggatttttttctcttttttaattccttaggtgggataggatggctagaatgggctagagttgtctgtttcccttcacccacttagaaggctagaggatcttggagatgggtattgctttcccccaggctggttaggtgctgataaaactcttattaggttaggctctgttaaatagattttttctgatggcagaccttgttaagaatagaatgctgttatatttcaaagtgtttttcccctctccctgctgtgatcacaaggtgagttttttctgatattcactatgagaactgactgagcttctggagctaaaactcataaaggtgtggggaccctccctatgcctgggtacacctagagtttttaattctcagacttgtccattcttagcctccagccattcatcagctatgattcaggttttcctgccccagccctagttactgtggtggtttctgtctgtgagtttctgctttgataagctgtgattctctctgtagctgcctgtctgtctctccaactttgagagtagcactttgctctgtgacctgattttcttttacagatctcataacagttgttggttttatagtttgttcagctttttacttgttgttaagatggagtagtgacttccaagctccttacaggctggactagaaaccttcgctttccatattttgaaatgtattttgttttgtgttcattgttgatacttcttgagctacatggttgctaaactaagtaattttcaatgctatggagagctagctgtttaatgtaatctgtgataaatttccttggaaagtattatatcctcttattttcaaaaactttggattttttttgtcttttcttaaagtgaaattctcccctgttacttttagaagaatcatagacccaagtttgatttgggtttggcctgacataccaggagcagttctgcagaatgacagtcttgtttggacttctccaaaactgaagtggcctctctctctgctcctctgtacaggggacatgcagtggtcatttcagatgtgctagggcttctccaagctcaagtggcgttcctcttttgttcttatgtatacctacttctcatcctgaggtttacttgactcctgttgcagaggaagctgaaggtgaatgatagtttccttccctgaaatttgctgccagtcttgttatccttggcatttctaactctgacatgacactctcacctaaattggctgatgctgatttctccctggatgagaatggcagtctggattcattactttctcctttcttgggcacatgcaaattttcctgttcttgctgctgctacccaaccatatttccgcctcagcattaggtaatgagctctcttttcatttttatttcagagaaaacttatccagacctattggcagctctgttctaaataaaatctttagttctacattctttcttctttttttcaagtgataatcatttgattctttttacctaataaattaatttttttctgcctcctttaaattttttccctagaaaagtacatatgctgtaaccaatcatttaaaatataagaagtgtatttgcctttttctttcagtgtcatctttattttaaaaaacatatttgatatgaagtacaaggaataatgttagcatctgtgcaatatgaaacaattaggtgaacattgtgaataataatggggagaagtggtatctgtgcttattacacatttcccctagaaaatactgtgaaaagtatggtttgctgtattttagatactccataattaccatgtggatgtgagttgttatggtaactgggtttctccccttctattaaataacagaataaatggttgcttgagatgtgactgaattgtcagcttaattgtcagctttcaagctaatgttaccctgattggaaacagtggagaggtaggagagaaggagggaaagagggaaggaaggagaaaaggttggggagagaatgttaaatttccagaaaacacctaggaagagatgagtgtcattttactttaaaaagtgtcctcccttctcttcttctcactatctgtcagaggacaggtctaacaaaaaattattttgccccaacaagattactgttgatggaatactgaagcccattatttcttgtatataaacaataggatattgagtggcttttggggtctctaataccagttgcaaatggtttttttttctgggaatgtggaaacaatgtgtgtgtgtgtgtgtgtgtgtgtgtgtgtgtgtgtgtgtctcataaagctaaatgtagtggttcagtatgcatatgtgtgtctgggtagcagttgaagttaaatacatttattttgataataacatttacatgtggcaaacatgaaaaatgcctttgtaagattggggttttaaaattaacagcaaatacttagtttacttgtcaatttttacatgctactcttccaatcccattctagttcgacaatcaaagaatgccatcaaagtttgttacctgatttatagtatttaatgaagggctgttataatgagtattttcttgtagatggaataagcatatttgttaagatcactcaagaggtggaatgcaataacaaatttttgaacaaagtattctgaactgtaaattaactaactagatggatatgtagtcccttgtagtaaaacatgtatgaggaaacatgattaccttttcattttctctcccatcattcccctacaattgcgaattatgtttctaagcagaacatttcctgttgtgatagtatttcaaatatacttaattaaagcttacatcatacagatttaaaagtttacagaatttcaatatataaaaattataatatctgctttaaaattttactgtgtcattcaatatgtttttatctggaattaaacctttcctggctagaacattttagacttgcttttgtaaaatctgcaaaactgtcttctcaacaactctgtgcctatttaaaaaaagttttaaattttgtgtttccagaatgatcacaacttgaacaccataattttctacaaatacttgcttatgatagtatgattttcacacgataggaatttgtcttaaagaggatgctacatatttagttctgttaaactccgcaggtccttaattgaacacttatgtgcaagacactgttatgggtaccatgggagggattccagcatgaatagaacatgacctctgctccttaggattgtatgagattaagatctaaagacagaatctgtggagtgttgtgggagaggcacatatatactggaagtatggagatgagaaaaattatttcagtaagtagaaatgagaggaaaatcggtcattcaaggaagaggaagcagtgagtgcaaaggtcctgtgaagtataagacaagcttgggaatcggttcgtaatttgatgcagccagaatgtaggttatataaaagagaggagcaagacatcaggtggagaaattggttaaaggtcttggccagcagttatttcttaaggtaattctaaaagactttgaacattatacaaaagagtttgggctttattctttaatgaaccatcaaaggttttgcaaagttctgagttaatgtattaacagtaagggtagcaccattggggatgtgttaggacaaggaaagattttaagctgttaagagatcagttactagatcatagtaatctaggcaggaatcagataggactaaaccaataaaggaaaaagttgggacatatatattaaatatttcagaagtagactcaagaattgagtctcaaggcaagggagattcccaagataaatcagaaatttcaaacttgggtaactggaacattgatagataatattgatgggaacaggaaagataacaggaagagtgggtttcgaatgatgatgacaaagaagtgtgcaaagtctaatagatggtgagaggtgaaagtttgagaagtacatgttctaaaacttgtgatttttttaaactaggtattttcaattctatttttatttgggtataatatgaatacactagagttctcacattttactgtctagttgtatgaattttggcaagtgcacacattcctccaaccagcaccacggtcaagatgagaaggttctaccaccctcaaacatttccccatgctcctttctagtcaggccctttccccacctccatctcctaacaatctcacatgaccaagagggctgaacttcaggctcctagcctcatcttcacttcatctagacaaattttacttcggttttctgtcttatatattggcattttactttatattgaatttggggtagggtagaaaaattacatagttaaatgtttgaaaatcatcattctactgtgttactgataaagctctgtctgagctgcctttatctctttcctggattgttgacgtcgcgtctgagtaggttttcttgtgttgacctttgctacctacagtctattgtcaacagagcagtcagtattgtccttttacaatataaattagatcatgtaattctttttctcaaaagcttataatggttctctctttagtaagaataaaagcaagtcctgaacagtgccctagaaggccctgaattctctgggtccccgttaattcactaactttttctctttctactctctgttttgctcattttgtctattgtagttagactgacctcttttctctttctcaaacaggtcagttgtatgcctgcccaggacctttgcgttaccattttttaaaattgaggtgtcattcacataacataaaacaaaccattttaaagtgtgcaattcactggcatttagtacatatacaatgttgtacaactatcacctctatttggaaatgttagttccaaaacatttcaatctcctcctttcatgtacccatgaaacagccactttctattccctcctcgtttcttcctgtcttccttcccctctcccccggcagctactaatctactttctgtctctatggctttacctattctggatatttcatataagtgacatcatataacacgtgaccatttgtgcctgacttctttcactttggcataatgttttcaaggttcagccatagtgtatcagtacttcattctttttgtgactgaataatatttcattatatgcatattacatattttattcttctagtttttccgttgatggacatttggattgtttctaccttttggctattgtgaaagtgctgctatgaacatcgatatacatggatttgtttgaatacctgttttcagttcttttgggtatatacctaggtgtggaattgctcagtcatatggtatttctatgtttagctttctgaggaaccaccattaagtgttttccataccagctgaaccattttttattcccactagcacttactttggtctttacatcctcacctcctccaagtttttgcccatactttaccttctctacaagatctactctaaccaccctatttaaccctgtaaccttctcgcatccctgccctcacctcattagcattcttccctcccatgtatatactcctattgtgggctcttctttgggcacatgtgtagtatttcattataattcactgcctcttacacattgaaacttgactgttagtcttccctaagccataggactgttcatctcaatgctccatcagatagctgtcattgcaagagtatgagtagttatagaaaaaaatttcacacattcattaaaactgagtgagacagtggttgagaaccctactttatcatctgctgaataactaggttgcaacttcatgatttgaacttattttgttgattggatttttttcaaaggcttctcacaagtatagcaaattggacataattgtcatactttataaatgctaattgaatttatttttcaccctagcaacattaacctaaaatataggcaatgtggctgactatacagtatattaaattgaaatagcattctaaaatgtgtttttgttaaaaatggtcagggaagtcctttttgcttgtgacacaatgggaatgtaagggcatgactttcttcaagctgtttctctaaagtctgtcttcattaagagaaaaagcaagaaagtgcatttttaaagagatttgtgcacagctgactccatagaacactaagtctagggtataatcccataaaacgtggggagttcaggctggcttctaggctgaagctttctactgtgctcctgtacccaccttcagctgtggttgaagcagcaggaagaggattagctttaaccttgagtttataacctccttttaaataggtttcctggcatgaatgttttcatgtttagaggctaaacatttgatttgctcattttcatttacattttttccataatcctttccttttttaaactcaagtttaaaaagcatttgtgagaccattgtcttccttgcaaattgctctttttgccaatttgctgaggctaagggtattctcagtagtacaatgatatctatggattattcggcaaaaatttaaaaatattttaagcttgtaaagtaagagataaacattttggttgtggtgattgagtattgtttctgttaaatccagctgtcaaaatagggctcgaagataattaatatattttatgaaaagggaacagaactgataggaaaaaagttgaagaaaattgcccacattttggaaataaagagcagagccaagacctgattaatgccttgccagctggaaatagagcctaggttgtagtttgccacctggataacaggagaagaagcaagagctggaggactcattccttcaaggatttatgttgacttattgacaaggctgccctcaccctgctcgttgtagtacttattcaggaaaagtcctgtctttataattacttttaagttcatttcatggctgagtatctgttttatactgtttgagattttttttttttttaaaaacagcaatgccatgagaagtaatagatagcagtaagaattaatctctttgttctttttattcccatggattcttcctatttgtgtccatttctgggtctctcactaggtggaaaagtctctgcagacacagactgattgataatctcatctttccacagtaccttgtatatagtaggccctcactaagactgggattaaagaacatactagaggccatgggaaccaactatattcagagaggctattatcttcttatcttccctatcacaaggcacttgagaatattaattcttataatacaataaaatgtccttaaacactagttatcatgattctggtgtaattacatacaaatttgttttctctctcactctctctcttttttttttggtctgtaggacacaaagtaaagttgtagctgtttgactttcgatgtgttacaggaatcatgaaatgtgatgcactgtgactgtttttcttgattgatctttctttaacagaagcagaccttgggaagatttgttgcaagatagccatgtactaataggtagaaacagaaatgactatgagaaccagatgttttgtctgggcctctgttgagaaacagggtttgcatgttggtatatataatttgtctcttgtttacccacactgattaaaggccatttatctagtggtgtgcacaattgctgtgtgcagtactcatttgcctgctcttaccactgtggtttctacacaacatgatatttctgttggcaatataaatttattacttcagaatggtcatattggaaatccaggatatgagcaatatttatttttatttaaaattactacgggggtttgttagacaatgccaagtttcctgacattggcaagaggccttacagagtttccccctaattttcgagggttgatttgtattacatgtacattttaacttgttattattgtaggattttatttgcttcaatttacaaaattctaggcttactttattttgtcttcacaagactctaaactcttctccttaggaatatccaaaagatattatttgtggttctgatcctagactgatttggtttgttttcagaatctaaaccacttaaggaaaagaaagaactgatgaaacagttttaattttattcttttttaatactgtgtagcctaatatgttgtggtacatttttcccataggttcatatccagctttcagagtggcaccgtgcaatttttcttccacaggcctggcttgcatacatgaatcgagcttatcatgccattttacaggtaatgaaaccacaggataggtttgctttggcgaaatgtctccttatctcatgttttgctacaaatgtgtatttaatataaaagcacttgggaaaatagcactaccaaaaatgtaatggttatttttactcataaaagaatgtgaggcatatatatatagcattgctgcacttaaacatcaatgccccccaaatccatgtgtcccatccagaactccctcttgagtgccagtctcctccatcctgctgccttctggacatcctcacttggctgccccacagcacctgacttgagtgcatcccaaactgagctcattgtcttccattatacctgtgcttcctcaagctggacttgcttacatctccagcctgatctcttaaaccttcccccatatttttatgtttcagtcttgttaaatttctttgttttcctaaactcagcatgtcttccctaacctcttagcttttaaacacactattctttctgtctctgaccctgccactccctctttacccacctaattttacttgttctttacccacctaatttctacttgttctctagatcaatttatctggtcaggcactatgtgccttacttctctccccactggattatatgcccttcttgtatctgagctttcctttttgaagcccttatcatgttagttatttggcgaggacttccagttgtctctgtactcctaaggacaggagctctgttgtctctggccctgacataagtgtctaaacgtactaggtgctcactaaatgaatgagatatactcaatttgagtttatttgatccaataatattataagttatagtttgtgaatttttaaatttagaaataattttaatcagttggggaatatacagttaacaatacaagaaaacaactagcttaattgtttttcgtagcttaaaattgattattaaggataataggagaaatccgatgttactgaagtaatttatgtcccagagtaagatttccgtgaaggcttaaaagtgaggtattgtggttagagataacagctgtcctataaaatgaggtgggcggggtgagagtggggcataggatggggtgagaggaatgactgtctgggcaatggtgttctaatctcaaattaaaacctttttacaacccatcttacagatcttagaactcgtaaaacactaatgtatcttcagagattctgatatattagaagtgaataggggaccaggaatctccatgttttacaagctgccaggtgatttaaatccacgtagtctaccagccaaacttagagcaaacagttttagaagatcccctaaatgtactgtaatctgcattttaaagatgttcctttggaaccatcgttttcttttgcttgttgtttccttactcaatttttatcttcagcagcatctgggcacccagcatgttttggataaatgcatgagtgaatgaatgaatgactcatgtctctatatttctttaagagccaattacagtttttagtcaggaaacataagattgcaagtcagagtatgtactttttctcacattcatttttccctaagcaatgttgaattttttcttcaccaaacatttatgtaacatgttttattggggaggtcccatgctaagtgtgtgggatactgagggcactccttcctcacaatgagctcccagtccactgggagaggctaacatgcccactagcaattccagtacagtatctttgatgcattaataaaggatgttcaaaatgctatgggcacctggagaaagggatgaagagctcctcctcctgcagaatgaactaagaattctatttagctcttagtgtaagaaaggctaaattgaatagggttatagtataattctgcagatgacttgcaattgattaaaaaaagccatgaatttttaaataagagctatggtttgttgagtaactagtgtgtgtccagtacttaacatatattatttcaattaatctatacagaaaccctttgaagtagatgttattaaccccatgtataatgggattatagatgggaaagcagggttagctaggaaagcaaagcaaacagctcaggaacccaacaagcactaaatgaaaatacaggaacttaacctgactccagagccttagcgttttccactgtgacatgtattttccctaacacggttattaattgttataatgaataatgcaaatttgtttaatattttaaagggcaaatctatttgatctatgaaaaacctgcagattattcataatttttagcaatgcaggtcaattattctgctattaaggtgatggttggtatctttatttatcatttaaaatccctttactttgtatttctagtaagtccagttccattgagaattggtgacaaaagaagagaaagtgaaaggatggattaaaataagatttgcagtattatttaaaaatacagcagtgtgatttaggctatcactattacttgaaagtacactgatgcatttatgcttaaacaagttttttaaatgagtccacacgcttaaatagagtttatggtatcttagaataattggagcaactgccagactccttgtctatatcaagaatttcggtcctagaagacactttttctgtacaggaattacagttacttccatctggtgctagatgtattttttagcattaaactagaggatcatttagaggtgccatgttttattcaattaagcctaggaaatgcactaaaaggtagattctccattacttcctggaggctaattaggatgtaagtctgagatctgaacactacttgtagcttctgcttagacgtctgcttcaagccttacctaatttttccataggaacttggggtttttaactataaatatatcaaagtggttgacatggggagaggtatttagatttcttcccattaagataaaaaatgcagatagaagccaactgacagtacagaggccattttggttaggagccgtctgcagtctttatcttgttacccttctgggatgctgtggaggttaaggtctccagcctttttgaaaagggctctttggaattgtgaatgtgacctcaaacaggagagaggtatgaaagcaaattgactgtagacatttttcatgaattggccagctagttgccaaataaccagaaatcagagcccagatcaggaactgcagcttccagtaagttactctatggcaatttataccttttttgctttttttgtgtgtgtatctttgttttgttttaaatgtgtaggaagctaggtgaaattgcttactataatcagcaagttcttatggtacaggctaaagattaaaaatcagaggggatagctagattaatcattggaatctacaggcaatccaaaaaaatctcaattcaggtgatcactttagccattttgctcccagtatgtgttttcccaaaaatgttaatcagaaagcagagatgactgagttgaatgctgctggatctctctattaccagtaagtcaagaattggaaggcgccatggatctgagtaaatagcccaacatagattgggtggcagggattaataagggagacattccagaaaagaggatagaaaagaacagagactcagagaaagaaaaaacatgaaaactacttagtcacaatagaatggtcgtgctgatttgtgactgcagggaagattaaaacggtaggccttcttaagaaggtgcatgtattctagttttcttgtgttttgtttatctttaaacggatttttaaaatttcttgttccttgtcttttttggaaaagcattataggaaatgttttaggagtaaggaggcataatttaagaagcataactgagacaggcaataaaaattgttttatactttgttttgcctggactcctgggaggccaatattaatatcttgctaatttccaagaaacaaaggggagaatgaaagggccagaattctatctttgaaagtatggagaatgaggattgatatgattgaagcaaatgaactatgaaggatgtgaatacagtgtccgttacatctcagagtgcctgaactggtgagccccagggtatggtgagtcgggagttgtgctaaatacacaaactctgtagatcgataaatagtccttgacctcacagggtgagcaactttgagaagtacaaggacatataactttatagtctggatattacatttttgggacctcttactccatgagattatacagataaaaatatgaattatttcaggagatatttagataaattcatgaaagacggttttgtaagaaaataagagggaggtagagatctttggttattgacaacaaatctaataacggtagctattatttgttatcaggcactatttaatgtgatgctttaataccacaagatatttgttggccactttttacaaatgaggaaactgaagcttagagaagtgaagtaacttgcctaaatttacacagccagtaggtgtaaatggcattaggccgaggcattctgagcccatgtccttaactcttcaatgtgtatcacttttctaagtatggagagatacatacttttcttctatacactatatcttagaactttaaaatcaataagaaaaagacagctagtagagaaatggacagaatagaaaaatcctgatagttaagaagatatgaaaagatcctcaatctcactagtaaacaatgaaataacattaaaaccatagtgaagaccatttcatatccaccaaaatggaaaaaattaaaagcctgacaattccgaatgctggtgagaatatgaagtaaccagaactcttgtttactgcttgtgatatgtaaactggcacatctacttctgataatggttgggcattacactgctgaattcttgtccaagttagggcccatcaacaaacagtattttaattatagataatttagataatgtaattggtgatggagtagagggggaagcatctgattaaaataattctgagtaaaaaaatggaaaagataatacatatttaaaggccttggacttaaaggaacaatgttagcaatattttttttcacatgctagaatttgggaattatggtacctatttttataagttcactcaagaaatagaagtgtaatgtagagctgttggagaataacttatattatatcttaccggaatcttaagtgttacatactttagcttgttttctagttttctattataatactggtgtatggtccccaatcttggtatattttggtgttagctaaaattatcagttgctaacaaaggcagatcactagcaggtagattttttaaatggggtctctgaaattcaaatttgattcagtaggtatctcaaaattaaattctctgcactaaatttgccaaacatacaacttctctaggatgttacctctttggtgaatgtagaaatacctgagcattgatgtgatgatttctcctcacacatcctctttcataatctaatgtcttacccagaacacttaaggccaaatggaaaaggatatatctgtgttttccaaagaaattttaagatcacttcagccatcgagttcacatgctgatttatgctgtgatttttgcagggaagactaggagagctggagttgcagttaaaacatggaaaagaagaacctgaggaggtgcagtacaaaaaaagcacagcctggctctggtaagtgttcatgttcagctgcccattatttgtcatgggaagtgagctatgaggggaaaggtaactactttaaaggctttaagattagcaggtttaacctctatatgtgagcctgaaggggaaatgacagaagagctgataggtgtattccctagataggagatagagagctttatttataaattatacatacacacacacacacacacacacacacacacacacacacacacacgttctaaaacaatgtggaaacagtttgctttttcccttttctacctgtaactgattattttatatgcttttgaatgaaaaattctttttttcccactctgttcattgctttcctacctcacatgtagtcaaggattacttctcccctcctctgctcccctcttccccaagacataattattaggagcaactttaccgtgtcatgggtttaatttctttggcagacatttcccagggaattcccactatatcatctagaaatatattagtgctggctcataaaagcaacttaaactgtttcatgggttgagaagaatactctatcagatttgtgtttcaccagcctaaatgtaagtaaagtgcctaaagtctaaatagctttgcctacaaccacaggttgctttaatctaaaaatctgtccgaagattatttaattataggttttcatttactgacagttggctcatgtagaaaaggagaaactgtgtgtatgtatttgattaattgtattctaagtcatattttctagatttatcaaaaaatggcaatgaagtttaaaacattatgatattggatttaggattagagggttttgtatcctatttgctcttatcttttgcatctattttaaatttaatcatctgaaagtgataattggtgaagtagtatatttgctaagttctttaaaatatatagagagacctatcaatacatattcctagtgaaaactcatgggctgtgtatatatgagtataaaggagttaggtccctagaagtttcttaagaatgatttcggctggatgtggtggttcatgcctgtaatcccagcactttgggaggccaaggcaggtggatcatttgagcccaagagttcaaggccagcttgggcaacatggcaaaactctgtctttccaaaaaaaaaaaaaagatacagttaaacctgcagtaactaataagctaccttgaagtgagctcttcctcatcctcacttaattggaacacaatcccaaatctaagtaaagtcatcacttgatttattatttcaaaaagtatttattgagtgtctgtcatgtgccaggcactgttctaagcacagaggaacagcagtgaataaagccccttctttgtccctccaaagcttatacttgagtagatggaaacctgtaataaacaaataaacaaatggaatatgatagaagttgattcatggaagaaaaataaagtacgatagagggaacagagagtgaatgaggcttgagggaggttgaggggtggcattaccattttctgtacggtgttcagggtctctttaataatatgacatttgaatgagacctgaaggaagtggtggagtgagccaagctgatatctggagaagagcattctaggaagaggaaacagcgaattcatcataggccctgggagtgtacctggcaaagcctgtgtggcatggagagcgcaaggatggaagtagtggacatgagagtagagaagttcgggagattgcagggtggagagtctttgtcagcacaaagaggactttgtgagtgagatggagaaacattggcagatcttaatcacagaatctgactcatgatttaaaaggaccactccagctgttatgttgaaaatacaccctgcggggcatggttaggagtccgttgcaataatttaggcaagagataatagtgttttagactaggatgttagtgtggaaaagtaaattgattttgaatctattttaaggcagatatcatacgttataaatgctaataattgaaatgaaggatgtgaaagaaagggatcaatcaaagatactccaagattttaactctaaacaaaagtatggcatttccatttaagacaaggaagactagagaaaagcaggtctgcgtagaataggaatcagattttggacttaggcctgagatgcctcattagcctccaattagagatagcaagcaggttgttgactagtctatagttccagggagagctcagagctagagaggtgaatttaggaaacatcagcatattgatggcatttaaaatcatgatgctggatgaggtcacttagggagtgaataaagaaagagaagatttcaaaagattgagccctgattctatatttaaaggtggggaagatgaagagggaaccaataaagcagacgaaaaattagttatcagtgacgtagaaagagaaccaaaagagagtaaaatcttaaaagccaaggaaagaaggcattctaaggagcaaccaactgtgtcaaatactgttgttaggctgcagaagatagggactgagaattgagcattagattcagtctcttgaaaataattggtggtcatgacaggagctcttttggtagagttattgagacaaaagccaggttctagaaggatctagagagagtggaaggaaataacgagagtcatcaagcataatcttttacacaagttttgacgtataacagaccaagaaatggggcaatagctggtgggcttgttctgctttcttcttttagagggtagatactacagtatgttcacatgctaagggaaataatacaagtagagatggaaaaatttgtgatgcagcagagaggagggagtagagaggtagctttagtgcacaagtggaaggtttgaccttaaatgtaagtatacataggtcatcatttgtaaatattccacactgaccaatgaaatattacattgaatggactatattccatttaggaatacggaaattaaacagtacattttagagaaatttgcagtcaaatgcttttaaaaaatacaagattgagatctataggaggtgttgcacctgtctgaaaaacttgtctcttaagagtgactcattctcagagtgctgaatagctaagattttattatatatcaaatgcaaatatttatgaatgtcaatataatttatatttaaatgcaacaactttaacaatatttataaaaccttcgaatttataaaattcaatgtttatattgaaaatgatccttttaaaaaagtaaatttgacagcaagtggttgttttttacttcatattgaaaattctatattgaattaaaaattaggttctgtaaatatttgaattgtgcctaccttctttctaacccacaagtataattattttcttttggctttcctgtgactatataaccaaagtttgaaattgcattttctataaacacatagcgactatttcatatgtacaatttgaaaattgtaaattgatgttttggtgagctctcatgtaaaaaagagagactgtcttagtcagtttgggcttctaaatgccaccacattggggattaggattcaatttcaaatgtgaatttggtggggtatgcaaacattcagtccattgaagagagtaatataatggacacttgtatactcaccacgctgtctgagataatactgttacagtgctatctgtacatcccccctcagttacatattcacctcctccttgcctccactcagtgaccttatgaacaggaagatgaagctatctgtaaagcagagcccttattacagttctttcaccttatactgaaattctacctgtatagttttaagatctggagccattgctggaggttcttattaattgatgaaaaagagaaaggaatgatttcttgttctaacataaactctcgtctattttccatctttattgcagggttagagacatgctgactgatgagatcaccaaggcagctgcaaagtaagatccatttagtcttttatcaaacattttttataaataccttttcctggcaggtacatacattttctccttttagggcatttcataattttaaggattttagagtacttttcaattatttttttaaaaaattaatcgttacccttcttatagtaggtgaattcttactacatgtctttttgtgaaaatacagaaggattggtactaacatataacttttacatcaggagtcactgaagttgagcccctgctgtatacctaacagatgacatgtgctttggcttaaacttaaaggattgtaatttagttcgaggggattaaaaaaaaaaagaaaggaatccttgctaatatgagttatgttggtagtacttccttttgttccattggtgttattgggttccgcatatctaaaaattgaatttttaaatactaaaaactaatgccaaggcccatttaaaaagcagttttagtcatatgcttatggttgttttaacaaaaattacttgagtgtcactgccttgatgctttttatttaccttaagccagctctcactaaaaaatacccgaaacttgcttgaacaatctcttcaggttcctttgtcaactgacaagctgactaattgttcctggcagtaagttacatgccagttacactcccttccaccatcttctctaactgctgccatttctgtttgactcctttctttcttgcctccaaccaacacagatatacctttgacctagaggatttcatgtgtattaaaagtccatatcatccagaaatttttaattgtagtatagtttatccttttcatgtcacaaaaccttctgtagctaaatagattttgccttaaaaacagaacaaaaaatgatctaccttagagttagctttctatcaataatttcttaaacagacacttaactgtgaagtctgatctcagcagattatcactgttcagtctcatgtcttctggataaagagaaatagaagtgataatcctcccctgactcagtcctatggaaggcactgggaaatatctgttgataaaatgaaaactaaagtacagagagcttagatggagactcattcttgtcttgttttcccactttggtgaattgcagacatagtgggagagggctcagttgcatatcagagggggaggggatgctgggatgagaatgcaggctgtctttgacctttacctgtaatagtttgttctcttatgtagtctacatatatcctattaaaagcagtgctctgacatttgctgcaaaaacttgaatgcagaagaaactaccaactttctcctaaagcaaattataattcctcgtgtctagtagatattgcaattttccattctaaaattttactccagtgtgactgtaattttcatattcacaaagtatcacttcgtgactaatacctaaagaaaatatgtttacatgagtaaaactaattcatgttctcatggtattaccttctcatcaaaacttacaaagtggccgggcgcggtggctcacgcctgtaatcccagcactttgggaggctgaggcgggcggatcacgaggtcaggagatcgagaccatcccggctaaaacggtgaaaccccgtctctactaaaaatacaaaaaaattagccgggcgtaatggcgggcgcctgtagtcccagctacttgggaggctgaggcaggagaatggcgtgaacccgggaggcggagcttgcagtgagcagagatcccgccactgcactccagcctgggtgacagagcgagactccgtctcaaaaaaaaaaaaaaaacttacaaagtatcttatagaccttattttaataaagcaatcttgacaatactaggaatggtagcaagtgtataagagatattttaggtctggaggctgagagattggtgatagagcaggggaaaaaatcattctgtcaccctctctgcttcttcccactggcttcctccaacatgaggccttcaccactgcccgctgccagcttagcttccctttccttagctacggctgccacaggctggtttgggtcagggtatggcttgttttgttcagagctagaagttaaatgcaaaaagtgacataccaatcatgggatgatcctgatttgttcatgtaagcccaaaatctcctcaagctgataagcaacttcagcaaagtctcaggatacaaaatcaatgtgcaaaaatcgcaagcattcttatacaccaataacagacaaacagagagccacatcatgagtgaactcccattcacaattgcttcaaagagaataaaatacctaggaatccaacttacaagggacgtgaaggacctcttcaaggagaactacggaccactgctgaatgaaataaaagacgatacaaacaaatggaagaacattccatgttcctgggtaggaagaatcaatatcgtgaaaatggccatactgcccaaggtaatttatagattcaatgccatccccatcaagctaccaatgactttcttcacaggattggaaaaaactactttaaagttcatatggaaccaaaaagcccacatcaccaagtcaatcctaagccaaaagaacaaagcaggaggcatcatgctacctgacttcaaactatactacaaggctacagtaaccaaaacagcatggaactggtaccaaaacagagatatacaccaacggaacagaacagagctctcagaaataacaccgcatatctacaactatctgatctttgacaaacctgagaaaaacaagcaatggggaaaggattccctatttcataaatggtgctgggaaaactggctagccatatgtagaaagctgaaactggatcccttccttacaccttatacgaaaattaattcaagatggattaaagacttacatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttcagcacagcaaaagaaactaccatcagagtgaacaggcaacctacaaaatgggagaaaattttctcaacctactcatctgacaaagggctaatatccagaatctacaatgaactcaaacaaattcacaagaaaaaaacagacaaccccatcaacaagtgggcgaaggagatgaacagacacttctcagaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactatcgcaaggtcaaaaaactgaacaccgcatgttcttactcataggtgggaattgaacaatgagaacacatggacacaggaaagggaacatcacactctggggactgttgtggggtggggggagtggggagggatagcattaggagatatacctaatgctaaatgacgagttagtgggtgcagcacaccagcatggcacatgtatacatatgtaactaacctgcacattgtgcacatgtaccctaaaacttaaagtataataataataaaattaaaaaataaataaataaataaataaatgaaggtgaaaacaaaaaaaagtcgagtcaataaaaatttagcaaattttcacatccaaaaaaataaaaaagaacatttaaagcttcagggataggggtaagggagagtcagaacacgtataaaacctgatgattgatgtgaatttatttcccttattatttattaaacagatttaaacctgaagataaaaatcactgaagtattgagtcactttactaatatgtaatgtaatactttgtccctaagaaagcatcattgtagctcagccttccttgtgctttttaattaggttaataacatcattttgttttaaaggacaatttaattaaaacgtcggtggtgttgcctagataaatactctgtggaagctgacatgttattatgcaaattagtctctcttgtttgactggtaggggatagttatttgagcaacaaggtgatgagtttttactgaaccagttatagattcccacctctccagctcctccttgaatttgtttcacttagtatgtattgagtaccttctatccataagtcattgtggcaggcatgaagggaatgcgaagatgatcaagagttagtcatggtacctttgtgaaatgtgtaatttggcctagggctgcactgtatagagtggactaggtttttaattcaaagattattatccaaatatgtgttcattctgcaaccaaatatattattaccagtgtttttaaataaatttttctccattacttaagaacaatacatactcagatatgtcaagactagtgaaggatttgaaataaaatagtttttggtactgttttaaaaccgaggctaatttctctttcagaattttggggttaaaaagaactttttatgttatcttgtctaatatatttgttttatgacttttgatacccagattctagtgacctcacgttttctacagagtaataaaactgggactctaatactcagatcactcaaaatttagaactgtttttaaaactcacctttagggattcatgaccattttgcagtaggaaaggcctcaggatattctgttaaaagaaagagataatattagaaataaaagatttaattttgtttttgttaaatgattttatggctagggcacctaggaatgaccaaatcccaccttgtttccttgtgttttcttattagctatatgagtgctctgtaattctctttgtagaactctagcaaaacccaggttggggccatctgcttagacctcaaggcttccttcccattttctcctccaaccctccccattataaacgttgatgtcttgctaacttttgacaggccttatagaggaatacattgaggtgggggggtggtggtgaacaaaatgatcaaggcttcaagtcttcacagagcttaaccactctaaagtggaagggagagggggaaggaaggatgggcgaatagataggaaggatttgttaatggcaagtcctgagtcccattcttaccaaatgaaagcagaaatgcaagaacacatgtgcgccagcaatttaatacccactgactcaagtcttcaattgagactatggcttgggacttgaggtactaggctcatttagggagcagagctgaaaatcttccttatccctcatatctgttatagtcctgccctgaggtaagcaggaagtggttcttggatcatgcactgaattcagattcgggtttgaagtccaaattttggggaacattgtatttatgggaacccacatcaaaggactgaggactaaacgatctgatggtatgggtgctcttgttgctggagttctgttataaacgaattggcaaacctagagcatctgattggtgtcccataggggactttataggatcagcttggaattatggaataatattaaatgtacattttcaagtggtaagtatattaaaaaggttcaggtttttacgttaaattcagaagtcaaactcttaagagtttattgctgatattagaaggctaccatttagatgatgtaaaaaggcaactttcagtccaaatagtctaaaaacagccctttttcatttgcatcttatctggggtctccaaattatattacaaactgggtttaaggttgatagttttgctatattaagagaaagaaggagaggataaaaatgagtaagaaaagctgctgtgtgtcaagttgtaaggtatgcaggctgaagtggtttgctagaagccagttcaacataccggtgcttcagaaaagccaaagattgttctattctgctgggcttattgacataactgtcttagttatgtctttacaacaaatcaataattttaaattggccaaagatgacacagaagagatcctaggaaatgtaatgttaatagatgaaataaaaatttaggaagaaacaacttactaagcttggatttttaagttatgaaaaggcataatgacccatactacattgataagaagaattcagaaacagctctagagtcagaaggaaggaaagaaactgttggcctaacacaacaaacagacctgcatttacaagactctgtgaaggaacacaagttgctttttgacttcacctgccctcctatattagctctttctcttcttctggttaataccaaagttctctgttgaaatttttttccttttgaacagggagagtccggtagtgaaaggcaatgcgctgttagctctaagcagccttgctgtcgtcgtatctagacatgaagccagcctctcctcagactctgacgggctcctggaggttagttggggtgatttaaacaattggctttgattatgtctttttaagcctggctttaggtagcctggccctgggcttacaaggttagattctgtgattatggcaccaagttatagtacttgatgggcctttatactgtgagcctcagtgtcttcctaactttgctgcttttctgttttcctttctccatcacagttaagtggtcatttctatttgaaggtgccaattttatgccataggggttatctttttgtgattacatcaatggtaaccaatcttacaaggttaactaggcttactgaaagtgaacaatgccgtcaaaatgataaataagcagtgtttattgactgaaaaaaatgtactttgcattttaattgtatatgtcaatgacaaagtgcctattcatttttgcaaggcagttatttcttaattaaacatgtggtgagctggccactgttcatttctaatgtactttcttggataattcatatctgtctaaataaaaaggcatggatttattcttgttttaagtctcattatctggtagctgtcatcatctagagatgacataactgagtcgttaaaaatataggctttggaataagaaagtcctatatttagatcctattacttccacttactacctctatggcctatttgtagcaatttcctctttcagaacctatttctccatctgtaaaatggagggataacaatgctcaccagataggattgttcgaaggattaaatgaattaatatatgtgaagcacaacagctcatagatactaagctcttattaataataaccattcaaaattattcagtctgtctctgtcctcaatgagtatcttatgggctatctgtattctttttttgttgttgtgggttttttggtggtacactaaaaaaatcaactctggtgactcatttaaaccaaaaaggaacaggaagtatatggaatctagaagcccgtggaattaaaggcaaagcttaaaaactgtattttgggaagaacaagaaccagggcaagttgggtagtccaggcaacaggtactaatgaaacatctaagcagaccacctccagtgggccagaacaacttcagtcatttattatcctcatgtcacttaaaattcagagtcctttgggtcctaggcctaccccttggacagtgtaggacagctagtttgattgagcatttaactaaccttcaaacagtggggaagacggaactctgcaaagggtgttactaccagtaaacagagaataggtgctgtgtggcaaaagccatggatatatattacatgtagggaagggaaagaggccaagggattattgcatgaatgatattagttaattaccttatgaaaatttaattttaaacttagaatcttaccgataagaaagatggaaattttatagagaggaaatgtttcatgtctttcagagagccatggaatattttagcagaggcaacatgctgcatagatctacaacctaaaatgtcaatgcccctttctatgatcccttcactttggtgttatttttgttgaactaccagttatacagtaattttccccaataataaaggggtctagctcagagtttgagttccagcctctcttactttctcctccaccccaacacaccccaacacacattgagaaaccacacagtccaaagatgaggctttgcttttattcatgatgaccttgcctttggctgttactcaatgcaaattcaagacctcattatttgattaaagttgaaactttcaaacattattcaaacctgcatgtgaccaccaacaaaagatttgaagatgtgacagccttgtttggttcaaggaattacaataattccagttaccatgtgagttaatgaatgcttttgacatccatggtcatgaatgactttaataaccaagttttatttttaatgagtggggttttttttgttgttttgtttttgtgttctcttcctcttctttttcaaactgaagatgattcatgttttctacctaatctttcagtgagttgggtgaatgttgtcaagattcttgaaatgacaactaaatggtaatagtcaccagaaatgctagagatgttgatctgaattctgtgggctgcttattgcctcctttgtcaaataagaagtcatagaaatgagaaattttgaattatgttttttgcacatctgtccttttaacctccatattatcttcactataattcattcaacgcaggagagctctgaagggctcttggatagttctgttttgcagcatctatcctcttctgctaatttgttcataaaagatacatcttatttcttttggggcacaggtgaggatgtatatttgtcaactacctgtatacctcatacgtgcatgcttatagtccaagcagatgaagtttactttttgataacagcactttattgtttaatatagaagggagttacaccttagatttagaaatatctttagatttgttttctctgtaatcatttcatgtttttaattcatctgcaggttcaacctaatttcctttcaatgaaagagtgggtttccatggtacttgatacactcttggtcattgtggatagccattaccaacccagagggcaacttctctcctggttttattatgtaagtgcaaaaaataaaaaatgatcagaaaactcaagaattgactcttatgacatcagttggtcacatgaaatcgattatataggccaggcgcggtggctcacgcctgtaatcccagcactttggaagtctgaggtgggcggatcacctgaggttgggagttcgagaccagcctgaccaacatggagaaaccgcatctctactaaaaacacaaaattagccgggcgtggtggcacatgcctgtaatcccagctactcaggaggctgaggcaggagaatcactttaacccgggaggcagaggtaatggtgagccaagatcgcgccattgcactgcagcctaggcaacaagagaaaaactgtgtctcaaaaaaaaaaaaaagaaaaagaaaaaaaaaagaaatccattatatagtgtaatgattctcagccctggctatttgttagaatcacctggggaactttaaatacacacacacacgaaatattatctatataaaatatgaaaatattatatatgtaaattataagaaatatgtgtgtaaatattaatgttatatatgtacgtacatatgcatatataatgtgaaatatatatgtatagacatatatatatatatataaaagaaataccaatgtgtagtccccactgctgatttaattgctcatggataaactccgggcatcagtattttgagagctctctcagttattctaatgtgtagtcagggtcaagagctacagttgtagtagaataaacattggctgaaatgtggggactccaagtttctagtcatagatttttttcatttcagattgtgtgactttgggcaattcactcaacctctttgagtctttttgtcctgatttataaaatgaaggaattgaaaaatatcatctatagtagttgtagcccttgctccccacttcttgtttttgtgactgttgacacttacttcatcattcttatttttcttatctgcaaaatgaaagtaaaaattaatgctttgccaactttctaaaaagattgtgaagatcaaataatatactttatgtaaaaagttttgaaaactgttaaatactctataaatacaaagtaatgttgttgatcatttaaaaaaaaaagccacctgttacccatcctctgtcttcatgcttgtattctaagatttgaagcaaaatgagaaaacacttttttgttttggtttccttttccttttattggtcgtagtacatgctttatttctgtgtctttgtagaagtattttggtcctaccctattactatccattgcctagggaattataatggtcatgggacaatcagctgagtggcagaggattatagttaattttaataaaaatataacacagattctgaactgttgctaagatcatgaatttagcttaaaaccttaatgccgaaggtcttctctgtgtattttgtgtgcctctgtcctgcccttgggaagatctggtatgtattcatcaggggctttgggtttagagctagatttttaaccatagttgaggtaaaaaaaaaaaaaatgacttaccagatgatgtagaattaaattggaagataaattttgctcaaaaagttaattgctctatgatgatttactttctgtcagaagtgttcttatttctttaatgatgaatgaaaactttagatgcttatggaggtctttgcaataactatctagttcaggtattcaccagagcaggacactgtatgaaatttctcatatgctgcttagttcttgcaaaccaataaaaataatctctttactagtcagctctgattgtctcttacctttgtgaggttttgcattaccatacttttcaaagccctgttttaaaagtcactttatttcatgtgtgctaccagctggatcattttgagtaacattatcattaaaacagtgctatattaatttaaagtgtaacttagtacgtttgatttttatccttaaagtactaaagcttagagagcgaatgggcctagaattaaaaacatattttaatgtgctttaactgcaagggacaacactgcccttatggtgtgtctgaaactttaaattggataatagtgaggaatgataaacgggctttctttcccacttgagacatatttataaatgtatataacgtctggtagagctctctaacctgggattcttatagaagctgttcatattcagctgctctgtcattttattagggctgttattcatttcttttcccataattacatgtaggaaggggcatatagagctctccatttcattttgaatagctggttattgctttgtaaccaaaggcttttaggatttcaacttcctttttaattaaaaggaattaaccccctgtaggaaataatccatctactgggaagtgttcccaccaaaaattttgggagatgtgccaatagatccctgtgctaaatttatacttgcttctccatactaaacttaaactctcttcctcccttttcctttcttccctggaaaactcctagctttctggacatttataatgtggcttgctggtttgtccaagctcagatagcttcagttttttttttgtttgtttttctgtttttttgtttttttaatatatatacatgtgggcttttaggaacactgaaattgtttcaagccttatagtgagggaatttataacctttaaaaggaagacgcttgtaatttggtttttcagatttaaaaggatattattaattatttagtagcaaaacatttcattaataatgaaaacataatctatagacaaaaacgtttggatttttaaaaaatgtattattttgggtgtcggccggggtggatctaagagaagcttgtgtggttgtatagtgcttttatgataggtatgcttccttcatgtttaaggctaaccctgttttctttctttggcatgtcctagaagtcctattctggtgaaaacacagctagtgccattgcccgttctgctgccgccacggctttgtctctccttgtgccagttttcattatctcttgcaaagagaaggttgaggaaatcctgaacatgctgactgccaggttacctgggaaaccaagtgctgatgagtctcaagccgtgcaaatccacatgggccttgctttagggatgtttctctctcgcttgtgtgaagagaaactcaggtacagtttattaaaatattcctgcttttcttctttgtgattttttgcaaaggattttgcacccatatgcacctatatataaacattgtatctgagcaatatgtgtttgctaaactttctgagatgggcaagttgatcctttattcttctttaggagtaaatttatctatctaaaataccatcgtgtaggtattaatgtattttaagggttgctagtattaaagtgtttggttacttgaaaatcatttcatgcttagatgaaagccccaggtacctatgtgtggtggacatgagaaaagtcaagttatggtgctataagtaaaaagcttcttttttctggtttgtatgggatgaaaataactgccaatcttttgttgatatcattgaaaatgagaggagaggattggcatatctctagtgcctaaggggtgttgggaatcactgaattacctgagaactacatgtacccggctttaaatattgctttttttcctgtgccctggccacatttttataatccttaaagagtcttaatctgtgcatattatactgtgtgctttgttcactttgattgctcatttttggactgctaactttatttacccttgaatggagctaatggaatagactcaggtggaaaattccactaaatcggaaaggtttttttagtgcatcagtctgctttagttttgttgttcatactgcttattatttattttctagcaattcttagaattttatatatctacattgattgtagtgggctacaatatgaatacttgcttatcatgaatattttgatgtcaatgactaggcatttagccctgttttcctactttggaaatatgatagtagggagaggcattctgttgtgatattagattcttttaaattcctggttggcagaaattagttgtccaaaggcaagaactggtgttggtgtggataaactggatgacactatgctatatttatttcagtttgagaccactgattaagttcttcacaaacacaagtatgtgaaacttttatgtgaattgctattgattttggggaataccatatttcagatgatcattttcagctcttagaaacatctgtcagatgattgggattattctcttagtctttgagaccataagtgcaatatggccagaatattcatttcgtcctgttcaccatcactaataaatataggtcttgttctggagatgaataaaaaactgccctttgcatgtgatttgactgttacatatcttgtgtgtgtgacagaacacaaactatttttaaagacttaaaacttgaaagtgattttttccctttgctactatgctacaaatgacagtctctccaccatctgtgttcatgctctttctttggtatcttttcaagcaacatgttttgcaactaaaaatgagccgtagcagtttaattctaggcaactcatttcatcctattctggctctgactcctttcttcactaacttaggaggagatgctgctgcttttaggctgacaagcttgcatttgtggttaacttaatcatgctgcctggagaaacctatgatgattcccccagaacacttgaccctgcttcctaggttgtcttccattcctgtctgtctgacttgaattcacacctgaaggaaaccctgggcaaagacatcaggaagctccttccttagctgagcacccacagaataactacagattttaactttgccctaacgttcctgtgtttgatagcatcctccttctacttagggcctgtgtgttagtaatgccattactaacataactattcatggctcccaccttcccaatttgttggaattgaggaatctcaaatatttgccttttgatactaataaattttttaccaggtagtaacaatgctaacagagaatttcatctttggagaaagtttaaatttttttctaaaagcaagtgttttgagagctgttgattttgactagtcagtgacatcaaatgtgtcccaatgtggtcctttaatgggaacagaattaggacaatatgttgtttttcagagactaagaaatcaccatgtagaagagaattatgaatcacatctgtaattgcagcattttgggaggccaaggcgggcagatcatgtaagcccaggagtttgagaccagccaggcatggtggcagatgcctgtagtcccagctactcgggaagctgaggcttgagaattgcttgagcccaggaggctgaggttgcagtgagctgatgttgtgccactgcactccagcccagcctgggtgagaatgcaagactctatctcaaaaaaaaaaaaaaaaagggggggagaattatgaaaatcatttcaatttttgctaaggcttatgaaaaagtctcctgaatttaagttccatctaaaatttattcagaagctgtggaatgttgttccacagcttcttgcttctgtcataacccccagaaaatacaaaaatgatctctttaacatttgtttaggatatttaagtatattttactccaaaggacaacttttataggatttatttagttaaagctattaagtctgtgtgtgtgatatgaggggtgtgcgtgtgggcatttgtttttcattgcaaaaattccttcaccttgggcaaaactgctatagtcttggtttgggaaaatgtttaaaaaagtgctctctgcctggttgtcattcctggagttacattccacttaccatgatctgaagtagcaatatgagagttaagacgtaggaacctgtagctactaaaatgtcagtgatgaagcccacaaatctgcctggagggacaaccatagaaccttttaagttttattttactatgcaagtcatacttctcacccaggcatttataaaatcatcaattgctgtataaatgtaaacaaatataggtctaggattttctccccttaaaaaaaagtaagtaaaggaatagaatttataacctccacaactgagacatgaaatcagaagtgacagtctttgcaagaaagatttggaatgattattgataatgtcaggttaatacgttaagtattctgaagaaaatcacttaagcatccttagaaatatatatttggaattccgagtttcttttttatttttcaatggcttaaaatttgaacaggctaagaaaaatcaaaaataggagattttgtgtttattggtttgcaagtgattatactgctcagaaatccaattattgaataattggtcagacttagtttctgtaactaccaaataagaataggcaactcatcaatattgtcacttttttttttaagagaaatgctggtatttccagtaaaatattgagagtataatattgtattcagtattttggatagttgactaattttaaataattcattgtttccccttgatctttaaccagtgatatatctggccaagagatgaaccttcttctgatgaagtcgttggatgccctggaaaattgctgctttgacactagtcttgaatacaagtatgttgttcctatttccactctcacaggtacttagacattgctccctacactgccataagtcttgcatgctatggagaaatattttttatttttattttttatttccataggttattggggaacaggtggtgtttggttacatgagtaagttctttagtggtgatttgtgagattttggtgcccccatcacccaagcagtatacactgcacacaatttgtcatcttttgtccctcaccctcttcccacgctttctccctgaatccccaaagtccagtgtgtgattcttaagcctttgtatcctcatagcttagctcccacttatgagtgagaatatatgacgtttggtttttccattcctgagttacttcacttagaataatagtctccagtctcatccagattgctgtgaatgccattagttcattcctttttatggctgagtagtattccatcgtgtgtgtgtatgtgtgtgtgtgtgtgtatcacagtttctttatccactcattgattgatgggtatttgagttggttccacgtttttgcaattgtgaattgtgctgctataaacatgcatgtgaaagtacttttttgtataatgacttcttttcctgtgagtacatacccagtagtgggattgctggatcaaatggtggttctacttttagttgtttaaggaatctccacactgttttccatagtgattgtactagtttacactcccactagcagtgtagaagtgttctctgttcaccgcgtccacaccaacatctattttttttttattatggccattcttgcgggagtgaggtggtattgcattgtggttttgatttgcatttctctgatcattagtgatgttgagcatttttttatacatttgttggtcatttgtatatcttcttttgagaattgtctattcatgtccttagcccacttttggtgggattgtttgtttttgtcttgctaatttgtttgagtttgttgtagattctggatattagtcctttgtcagttgtatatagattgtgaagattttcgcccactctgtgggttgtctgtttactctgctgactgttgcttttgccatgcaaaagctctttcgtttaattaagtccaagctatttatcgtttttaactgcatttgctttttggttcttcatcatgaaatccttgtctaagccaatgtctagaagggtttttccagtgttatttttagaatttttatagttttaggtcttagatttaagtccttgagccatcttgagttgatttttggataaggtgagagctgaggatccttctgtacagttttattctcttacatgtagcttgccaattaagcttacatgtatcttaccagttacccccagcaccatttgttgagtagggtgtcctttacccacttgatgtttttttttctttgatttgttgaagatccgttggctgtatttgggtttatttctgggttatctattctgttccgttgttctatgtgcctagttttataccagtaccatgctgttttggtgaatgtggccttatagtatagtttgaaatcaggtaatgtgatgcctccagatttgttctttttgcctagtcttgctttggctatgtggacttcttcagaaagctcccagaattgataacagaattcagcaaagtttctggacacaaaattaatgtacccacatcagtagctcttctatataccaacagtgaccaagctgagaatcaaatcaagaaccccaccccttttttttacaatagctgcaaaaaaaaataataagatacttaggaatatacctaaccaaggaggtgaaagacctctgcaaggaaaactacaaaacactgctgaaagaaatcatagatgacacaaatggaaacacatcccatgctcatagatgggtagaatcaatattgtgataattaccatagtgtcaaaagcagtctacacattcagtgcagttctcatcaaaatactaccatcattctacacagaactagataaaacaatcttaaaattcatatggagaaatatttgtagaatgtgattttgaattcctttgcagagagttttcagtaataattaatcaaaaaacttattattaaagctttcttgttctgaaaaccaggtttcagcaatagacaaattatttaaattcaaagcaacaactatcatcttgcagcttacaccttatattactaagaccttagttttgacttacgtttatcatacaaggcacatgtatggggacatggatgcatgacttaatctttttttaaagtatttatttttatttatgtatttatttagacataatctcactcttattgcctaggctggagtgcaatggtggaatcttggctcactgcaacctccgcctcccgagttcaagtgattctcctgcctcagcctcccaaattgctggcattacaggcatacatcaccacgcccagctaattttgtatttttagtagagatggggtttcaccaattggtcaggctggtctcaaactcctgacctcatgtgatccacctgcttctgcctcccaaagtgctgggattacaggcgtgagccaccctgcccagccgacttaatctttttaaagatttgttgaggccatttgaatttgattgggctaagagggcctttgaccgatgatttatgtttccctgtgaaatcatgtgcctaagaagtagaaatggaagcaaacaggttatatcagggattaccaacctgcttagcattaagaacctttcccttccccatgctaaccccatggtttttaagttttgtctattaaactaaatgctttaaaattattttctcatttcattaatgaaagataaaaatgaaaaataatcaaaaaaagaattaaacacactcattttatgagatatttaatgtttcagttagtctgtgtgacttgtgtaggtgaatatatggtatggttttgttaggctttcggaaatactgacatttttgagggagcaacatcgtagttttttagacttccatgcgttttggaacgtcaggcatgaatcctctggtgttcattgttactaggaattaacagattataagcactaacttccagtttattgactcatttaccctttgatattatgggcactgctcaaatatgcattaaatcagtgtttacatttctggcctttaggaacttatgatttacagctacattcatactttctatcttgttagtttcagactaacaaaagggtaaatgatatggtagtggtagctgcatgtgtaaagggtttcatcaggaataaataaagtaaaatgtccatttaataggtggtagttatgggatcttctttcagatgcaggctgagattggagaggaactagtgccactcacctggtttctcaagaaacacttttggggtcaagtgacttcttaagagtgtggtttgaggccgggcgcggtggctcacgcctgtaatcccaggactttgggaggccgaggcaggtggatcacgaggtcaggagatcgagactgtcctggttaacacggtgaaaccctgtctctactaaaaatacaaaaaaaacagggatgccctctctcaccaccccgattcaacatagtgttggaagttctgaccagggcaatcaggcaggagaaggaaacaaaattaggaaaagaggaaatcaaattgtccctgtttgtagatggcatgattgtatatctagaaaaccccatcgtgtcagcccaaaatctccttaagctcataggcaacttcagcaaagtctcagaatacaaaatcaatgtgcaaaaatcacaaacatttttatacatcaataacagacaaacaaagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccacattgccaagtcaatcctaagccaaaagaacaaagctggaggcatcacgctacctgacttcaaactatactacaaggctacagtaaccaaaacagcatggtactggtaccaaaacagagatatagaccaatggagcagaacagagctctcagaaataatgccacatatctacaaccatctgatctttgacaaagctgacaaaaacaagcaatggggaaaggattccctatttaataaatggtgctgggaaaactggctagccatatgtagaaagctgaaactggatcccttccttacaccttatacaaaaattaattcaagatggattaaagacttacatgttagacctaaaaccataaaaaccctagacgaaaacctagacaataccattcaggacataggcatgggcaaggactgcatgtctaaaacaccaaaagcaatgtcaagaaaggccaaaattgacaaatgggatctaattaaactaaagagcttctgcacagcaaaagaaactaccatcagagtgaacaggcaacctacagaatgggagagaatttttgcaatctactcatctgacaaaaggctaatatccagaatctacaatgaactcaaacaaattcacaagaaaaaaacagacaaccccatcaacaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctagagaggatgtggagaaataggaacacttttacactgttggtgggaccgtaaactagttcaaccgttgtggaagtcagtgtggcgattcctcagggatctggaactagaaataccatttgacccagccattccattactgggtatatacccaaaggtttataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaaggatgagttcatatcctttgtagggacatggatgaagctggaaaccatcattctcagcaaactgtcgcaaggacaaaaaccaaacaccacatgttctcactcataggtgggaattgaacaatgagaacacatggacacaggaagcggaacatcacacacgggggcctgttgtggggtggggggagtggggagggatagcattaggggatatacctaatgttaaatgacaagttaatgggtacagcacaccaatatggcacctgtatacatatgtagctaacctgcacattgtgcacatgtaccctaaaacttataataaagaaaagaaaagaaagattgtagatatattaaaaaaagattatcttaccaatttttaagaattcattatatattatgtacatgaactttagtctaccatatttattacaaatatttttctcagtcattttgctgatttactttttaaaaagaatataaatgtattattaccactgaactgtacccttaaaaatgataaagatggtacttttatatgtatattttaccttaataaaaattaaattaaaaattgaaaaaaaaatacagaaaaaaaattagcagggcgtggttgcaggcgcctgtagtcccagctactcaggaggctgaggcagtagtatggtgtgaacccgggaggcggagcttgcagtgagccgagatcgtgccactgcactccagcctgggcgacagagcgagactctcttctcaaaaaaaaaaaaaaaaagagtgtggtttgaatatgagtaaagaaagagtttgatggcatggttgaagtatcttgaaaatagaaaatgattaatgagaaaaatagggaaatttagctgttatttgaatccaatgaagagttgagattttgaacctaatccatgcatttatattgccttttacaacctaggaataagatattttcatgtctctttccatccctcctgcctcctcttaccacccaaagatgttcattgtagcttagctcaagatgttataaagttgggaaaaaatgtgagattaagatgccgccaactttagccagtggcacagtcaggagtgactttcaggcattgtctccatcagttttcaggaaggttgtttaaatgcggggagtaccatggggatgaattacccaccatacagatactgaggtgtttaaaaatttcgtatgtccaagcatatttaactttaaaatttatttttgttactaataagtttcttatttcttcattcttaccttctttgttgattcttaccttcttttattttatttttttttgtttttattttttattttttaaatttattttattttttttctttcttttttttaaattatactttaagttctagggtacatgtgcacaacgcgcaggtttgttgcatatgtatacatgtgccatgttggtgtgctgcacccattaactcgtcatttacattaggcgtatctcctaatgctatccctcccccctccctccaccccacgacaggccccagtgtgtgatgttccccaccctgtgtccaagtgttctcattgttcagttcccacctatgagtgagaacatgcgtccaagtgttctcattgttcaattcccacctatgactgagaacatgctgcgtttggttttctatcctttttaatgaacaactatattgagagagagacgggtaggcctggacttcctgtccagttagtggacacttgcctgtctgttagagcccaattaaaagctcaggcccttcaagaagtccttcttccatcctctccaaacttttagttctacggttaatgaagtttagtgcttcatcattactaatgctctctaggtgtcagtccttgtgcagttctcccttttttttttttttttttgagataggatatcactctgttgctcaggctggagtgcagtgataccacaatcatggcttactgcaagttcgacctcctgggctcaagcaatcctcctgcctcagcctcaagtagctggtactacaggcatatgcaaccatgcttgactaatttttttattttttgtagagacagggtcttactgtgttgcctaggccggtgttgaactcctggcctcgagtaatcctcccaaccctggcctcccaaagtaatgggattacagatgtgagccactgcacccagcatagttctctttttggcttcaggttcaactgatacttactgagcagctgcatactgagctaggcattttcacatctgtttctcatggagttacatccatgtcacaacctaaacatgatactgaagtaggaatcatcatcactttggtttacagataaagaatgtgagtctcagataggaggcttgtttcagggtcatatgcttaataagtggcagagccaagagagaaacctgggacatctgacttcaaagccatttttctttcttacataacacagtatggataacacatttcaatagaaggaaagcagtttgatgctggacagtatactgtgtatttattttttttctgacatgcaagtgtcacccacacttttttttttaatattttaattcttccttctgctttttaactagacccagacctgaaagcctgactcatgatttaaagtattcccttatctaatgagatttcaggagtctagggcaagcctccctcaagtgaaacagtggaagtcttactagaaggtagttagtagatgcgggagtgtactccctcaaatgatagaattcacccagagcaaattcaccatgcttcccgatttaatggacatctccctgctgaaagaacccgcacacctggccaggctggtgttcgtgagcctatcactaagattttactgccatctagtggtagctcattgtgccattgtgatcctcacagccgtaactgtagtcatgcagtcatcaatgacccaagctttggttaattactactgagcttttagaaatgcgataacatttgtatagcgctttgtaaagggcaaagcgctatataaatgttaactgttattagaactaattattagatggcctagtacttaatctgcaggattgcctacagtaaactagggaattgaagattcatctctgattaattttaaaaaatatatatctgagttgatgcagcaacacaaatatcagaattgcttagcttttaagtttcaggatttcttttgctggtgatattttaatatactctgataatagattcaaataagtaatgacataatagtgtatggaatttaaaaactcaaattatctttatcatttgttagcactcttatagaacatttatgttagcaactccaaagttcagtttcatacccaatattataatttgtttttatttcctctgttggagacaccaacacttaactcctttttgctttcagtggacagaaagttataaaagctacctctgcccaagctattcttggttcaaagctggcagacatatcaaagagaagctagaatgaggtaaatatgtggaattgctgaactaagcacctgggggaacattttaagacttagaacaagaataaacacattaaaatatagaagatttagaaatcagagggaaatcaggaataaagttttaggactacattattggtgcatactggaaaattgagatgaatgagaggggacctattcagaggggcaatagatgtatatgccatagcatgtatatacatacactgttatatattcatatgttacaccagtcacttaactgccgctgtagcaatgaatagaatcgctagtgaattataacgttgctcaggttatagtaataattgctatgataaattttaggtaaatgtgaactagaaacagatgtgtttttcaaagccttaatacatctatctcctgagatgatgaaagaggggcttcaatctaggggatagagatatttatgtgcccaggatagcctgaaaagcaagacttacatacttccttgtttattcagaaagttaaaccctattggaatgagctttgagaggaatttgttttccagatgagcccaatattcctctttctgaaattagtctggcaagaaacagaaactgaattttcttggttgaatcttgcatgatacgttcagtgaattttactacttataaaatttgcctactactaaacataagaatcaagccttgcttttttcttcttcctctgtagatcttctctctactctagactcttaaaattcttcatttggttagttcttcagctttcaataaatactggttgagtgcctgtatacgccaagcagtatactaggtgcagcagatactgtggtagggaaaaaaacagaaaaggtatacccacccttatggagctttcaggccagggaagagataataatcaaccaataccccaaataattttcatcagagtttataattaaaattgtatgaagtaaattagcacagggtgctgtgggagagtattaaagaggctctctgctgggcgagagatgatgtctctgaggaagtaacatttgaaatcttaagcataagtagcagttaaatagtcaaagagagaacaacagtcaaatgtgtctaagtattaatcaaattttgtctaattatatctttggtctaattctgtcaaattgttatatgcatcaatatacaaagatagccaaaaaacttccctgtagattctaaataatagcaaaggctttacattcatattaatcaagagtagcctttcctcttccgtaaatgtgattagtctcaaaagcatgttctattgagatcttagatgttgatttaactggttgaaaatgcattgagcttgttaagtttacgaagctgtaacagcagttctgcctgactaatgatggattattactgtagtagcttctttacgaaggatttttgaatggctgatcgttatgcaacagaaactagaaaaacacacttgagatacggtgccttctcatacgtattccatcatggcaccatgaagggcactgagaggggctttgggtttggcagatggggcagaaggctaggaataaaaaaaatccccttgtattggccgtgctctgctggatgctctctgtgtgaccttgagcaaatcctgtagcctgtctatccttctgggtatcttcttttaggtgtgggtgctccatttgcacgttgggggaagtaagtaacatgttcataaaattatgcaaatgttcttgacactgaccaagggggtagatgctgtttaagagcaaaatgacctaacatgtgggcattgagatacattattggagaaatgccctggaatgtcttcttcggcagcagatatcatgatgagaggcaaggcaagccagagtaagggtgatttctgaaaaaacattgcattttctccatttaaaaaacaatgacaaaagctttttttctttaaagtaaagcattaccacaagctgcattatcttaccatactatcttgaagttttctgagagaacaattattttctttaaatggatatgtattcattcaggagaattgggggcacaaagccctagatttcaattgaattgtcacatggggtaacttttgacaagcctgtcatttgtccattttctcttctgacccagtggtattctgcaagatcagaggggagagaaggattaatgtcattgtgcacaaacagtttctttaggaaagaaattccacttgttgaagttgactaggaaacatgaaacacttagtagtacctcataatcatgccttgcatttatcttctttgctattagtcagatatcctcagctcacatcctgaattttagtcttttctctccttatgcagctgatcacagtatactcaacatgcaggtaggggtgttgcagggaaaactacagcatttctgtaagggcacaaataaagctggtttatgccttttcctcttctcacccataaagtttaagtcaaactatttcctgccttttgtttttatctagggggtgtacagcactagcatgggccacagatacatgttttgatgtcaggttttcattttgaggggagaggtatgtgtacttgtcatggatgatggggcacaccatctactaggcagcagaatttgaatccagccatctcaccaaggtttgagagctctgtaaacacccgtggtaagtgaagagcaattgtgtggatttcttatgatcctaacatcttatcttttttggcttccaagcacgggctgtatattgggagttggacttgttctgtccctcatgagccacagcagccaaatgcagtcccgcgttcacgtagcagcattgctccggaagctgtctgcgcacgtagatgacagcgggagccagagcagaacgtttcaggaggtaagagatggaggctacatttttttcccctctgctctcttttgttttcttcttgccacttattttggacttaccatattttggtaaccctataaattaaattcttcctcaaagagaaaatctgaatgacaaacaaccaatattagatcataaggttttcatattatgtggcagtttaaatcaacttaaacctaaatgtggcatataagataagagcctttagtgaatacaaaacctaactcagcatcactagaaggcactttctaagaagagctgcaatttctggaagaaggttaaatcgagatttttagaattgtgctcaagccaaatataactttcaaaaatgcccaggaataagcttcagaaactgctgatcaaaaggcgtttgattttttaaaatgtcagctagcataaaatattattgagaaaattcgctttaccacacttagagaaaagtttttttctgttgtggtgcaaaaatatgcagaattggagttcatgtgatccagttcatgggtgttaaccatgtttttagatggaacatttcaggcatgtgtcatgcctgtctctattttgcccaggtgaagctggaccgcttgtactcttctttgagaggagcagggtatgacctcgtggcctggcctgattctctctctcattagaacagattctattttatcccagcctgcccatgagctattgatgagtacataatggctgctgtgtttccctgctcagctcctctgctttcagcaataggacttgttgaattggtgaatttctttgggcacagaggaatgaagttttgttctaagacatgcactacatttccatttttaaagcagtgtagagtgtgattttaaagtacgtattttttttaagccaaaagagtaaatcttgcaacctaggagcaaattaattataaatgaaagcaatgtttttataactgatgcatctgtaatgttttgatttataaggccttaagcaagcagtttttttttctcccctctgatgttttattattcaacttctgccttagaaaccacttatatttttcatgccatatcaaccagtgctagaagttgaattttctactttgtcttaacagcattcttataagggaggttttttatcacgaaaaaaggaggtagcagagaggggatgactaaatttgatgtgcaaaaattgagactcagatagattgggtgacttgcccaaagttactacgctagtaaatggtcaatttgggacatattcccaaatcttggctccattcccaccattgttttttacccatattttatttattcattcattcattcattcattcattcattcattcattcatcaacatattaagttcccacactagtgctatgaggcaggtattagtattcctattttatacaatttatctgactccagaatccatattcctgttccagttatgctccactacttctcctagggaatcttaatggagcagtgtttcacttctttgaatttcctatcctgtttggccttggatgggaatgcatggcaattaattagtagcacccactggtgatgaaaatctgtttccttctgctgttgataggtgctgtgctctggcataatgtggtgaagaaatttactattatgagtctaaagacctgggcttgaatccctcctttgtcacttgctagctacatgaaattgagcttcaaagttcttatctataaagtaggaataatcatacccatcatgacagtgttatgaaatattacaatataagttaggcagaaaaacagtgcccaatccatggtaaatgtatgtgaatccaattcttactctgggggggagtttgacagaatatcttgtcaactaaaccgagttcttttatttttcctcctgaagacatatttttctgctgtattttcttctcaggtccttgcctacacacttagctgtgtatgtacatcagcgttcagtgctggaattattgaggctacagaggctgaggatgttatgaacaagcttcgactgttagtggagaatagccagcaggttggaacgtgtgccctgattatttctctctgtgggtctcatgctgctgctaagttttgcttttgacttactctgaattagagtataatgggatatttttcatgtctagaactgaggaacttctaactattctcttttctcacagctgtagccaaaagtcacagatgtctttttctctccttatcccctgtctcattctgtggacatttctttttctttgagagagtattgatatgcttttctctctctctctctgacattgctctatagttataagatcataaaatatatggctagggaatataagagttatgtaaagttagaaacaaaaatttgtgacgatatgaatacatagaagtctctgataaagtcaaacttcagaaaattcaaggcagaaaatctctactcatgaccaaatatgtataagaaaatttaagtacctataaactaaattaagtaaccttaaaatgtttcctgtgaaatattattcaaccttaaaaaagaaggaagttctgatatgtactagaacacggatgaaccttgaaggcattatgctaaatgaaataaacaaataacaaaaagcaaacactgtgtgcttttacttacatgagctgcgtagagtagtcaaaagcatagagacagaaagtagaatggtggttgctcgggcctacaggaagggaggaatggggagttactgtttagtgggtaaagagtttcagtttttcaagggaaagattctggagatggatggtggtattgattgcatagcagtatgagtgtacttaatgccgctgaactggtattcacagtaaagatgataaattttaagtgtacattaatacaatttaaaaaaactgaaaaaaaacattttatctgattacacatgctatagaatttccccatgtggattttttaaaggtttctccactgtcttaatattgatgataatgggttattgcagaattcattggttttaagctcgtaatgttatcgttactgttttatggttatatacccgctcacttacattcagagtaagttgtgaaaaattgaaatgtagaatttttcatatactttgctttttatgggatgctttctttttgtttaggagttgattgaccttgtgtggtctaccttggttttttcaccctaacctcttcaaattgtttgagctaagctgctcaatagtgcagtattactttcctgaaataaattactcactgaagctgaattccttgcaattagaccctgcagtttatgatgcaaaccagtctagattaaaaaaaaacaaaaaacaaaaaaacacttaagtctgatttttcatatgacaaatacagcttgtcattaggaaagttagcactaaaagtgtttatgttgctatttataaacattctaaatctgtgtcttttttttttctttttcttaccccatttttatttatttatatcagacttcaggttttgccctggctttaggaaacatagttcatggattgtctgtgtgtggacatggaaaagctgaagacttgggcagcaaactactccctgcctggatcagaattgttctaacagaggtagaggtcacctgttgtatgctatttcatatttttataatggaaaaagaactactttattggatcatttataggagttgctgagatatatacgttaatggtaaaagaataggcaattttaaatgaaagagatcacatacttttaaatcccttataaataatgcattctgccaactattataatttttttgaactggctattttgtctgagttttaattttaagacaacattttgttttttgaaaaataaaagcaagaatccacccatgatctaacaaccttaatctgttactttattttagtctgctgccatttttggttcagttatacaggttacgttgaccctataagtttggtaccaattcgaccatttatttctccgtgtcctcagaagttttatagaatctaaacccaaggactgattccctcttttcatattctgatgctttgttttcagggcactcccacaatgctttgtctggcagctcttcatggcatggtggccttggtaggctctgaaggggatgtaatgcaggtaaagaaaggaaccatggaggggaagacatctaaatatgtacatagccatagcgggagaagaatacccagtgttttagtatgctaagaacagaaggatttatgctcatggtaatagttacaccagactttttaatgccttgctgtatgaataattgcacttaaccaaggattatttctatagaggtttgttctttatttaatttggtttttagagattaaacctggccaacttaggtgctctccacaaatttccctgcctgagaaaagatgattgaaggataagaaatttcaaaagttatttgcaagaaactccattttgcatcttaatgtctgatatatgtctatgtggttgttctttaacttcaaaatattttcacagtggacatatatatgtgtaagtttataagtaattctaaaggagctctgtttttatgcattaaaagttgattgagtgattgcttacatgccacagtgaacaggtaccaggaaatcaatgatagataaagcatggggccctgcctttgaggagttcatagcttatgtatttgaaatagaaggacataatgataaactgttttataacttagaagatggatagctcatgcaccgggaatataactcttaacttttttatgggggtgggtgggatgggtatttcttcttattctttcagctgaaatcagaagccatccagacctctcattttcaaggcagacttaatgaagtcattagaaccttaactcaggtgagaaaatgaatttaaaatccttgggtggaaaacatatccccctttgttgtctttttttctattacatgatacaacatgttttacctggaaaatgggaaagtctctggttattcccgctgagttcaagaggcatttgggagtgatgtgtggacctgtgttaactgacaaacatgcactacctttgggaaaaaaagaaagctggcattttttttagtaaacttaagttggcattggtttttcttaaaaattaaagcctgattctgcgaggaatgtcaggccctaaagataaggaaaaatagaaggtgatcaaagggcatggcagatcttggtagaaaggtcaagaggcactaattcagatgtccctgataaaagtgtttgggcatatcattttaattgttatccttgactaaagaatagacatattaatctcctaagaaatgtttttttgttttaagatttaaaaaaaaaagattatgtttgttgcataaaatttgaaagcacgtaatgaaagaagctgaaaaaaatatcactgatggtccttcaaacctgaagcaactgttattgatatttcatcatacttcttttcaagtattcttttgtttgcatagttggtattcttagtgtatatagaactttatattttattcttttcatttagcatacttgttttcgttcttgtaaaatgtggctgatgataatacctatcacataaaggagttttagtaattcagacttttaaaagcaaacaaaaatctctgaacagacaaaactcttttttgcatgtatgaatagaaatattctcaaaaaataattctactgaaatttaagttaccataatgtgggagaaaaaatctgtaaatgaaaattattattttaaaaatccttatgaatgataaagcagcagtagagcataatttacagaagagaacaaaatgtatctccttccatttttagaggtattttcatcttaagtaactgtcaccccttttgtactttctggattttgttcttttgcaatttttttgaaaatttatttgagaccagtctcactcagtgaaacctgagaaaaccactagtactttctgccatgattaaatgattgattgaatcattcattcattcagcagacagttgttgagtatctatatgacacaggtatagcgtactagacacatgatattacatcttgtcataggactgctcgttgccagccaagccaccacctcctaaatgactggtgactttctgtgagtgaccttttattgaatggaacttggatcttatcccatcattgaactgttacctttttatttgtaggtcattagtgtctctggggtgattggtctccagtcaaatgcagtctggcttcttggacatcttcatctatctactctatcctcaagtcaaagtagagcctctggtaagattaaagtcataaaatactggagctggaagggagggattgccgacccagcgctctgtagtttgttaagagcattaatcttcacaacaaccctaagtaatgggtattaccatctctgttttacgtcagagggaaatggtgtatggaaaggcttcctgacttacccagggtcatgtgacagtaagtgatggacatgtggtttgaactcagatcttttggcctccaaagctcatactctttttactccttctctctgcctcccttagagaacagtttagacattcagtgtcctgtatttcacaaacgaagaactcatggctcggaaagattacatgagttacatacagagttaatttggtgacaaatctagaaactaggaaccaggtccttaaagcttggaacagatttattttactagatgtaatggtagtttgtatagtattcatgtttcattaaaagtctcttcatatatggctggagtttttctggcctccgattttgaaaaaataatggggtagtacatttaaaggtgtgtaccttcttagccttggaattgaaattctaggccttaatatgacaaggccttttctatttctagctttttggtaaaagcagtaaaagatatttgcagtcccgacatgcttaatgtgcatttgtacttggagattttctggggaaggcatgaccgttaatacatctgctccttgctctttatagaattttgacccactggctatcttggacccaggccagagaggttcaggtaccaatgattccttattaaaacttagttttacttacccactgacaagtagtctacagatggcattaacgtaaatgtgggcctctgaaattaccattttcctttctttcagtcattctgtagctatggaaataggacaactggtccacagccttggcaatgtagtgaactttagacagctaaagttaccatattaaaatggaaaaaagaagaaaacttagtcataccggaagccctgggtaatactagttttgaagggcagggatctcacagtgtcctggtaagataggatatttatggcaggcttttatttttttatgtaggcttttaattgccatattatggggtacttggtctggcctacatatactcaaatcaggtactagtgaatcatcttatacccaggttcttctgaacaaaatgattgtgtatctggaaaagtacagctacttgttcctgatggaattttccaattgagtcatttattgcagtaaaaaccatctcatgaaacaattatgggaaactggaaggaaaagaatttaggagaaactcaggattcaactagcataaatgtcactgcttcaccattccagctcagcaaccacatctggttatttgcacatgttggtcacttacaggtctctgccttaggtaagggattggtgctgttagtactagttgttgaatttctatggttcatatattcgattccacatgtcctgaagtggcacctactacagtggtctcagcgttgaagctcggcagactcgttgctgaacgctgaggaggtcactggattagggcttattgatgtgacaatgtggaaagggtttttttttttaaaccacttcactcaagtgttcatcctccgtaattttttttccagacttttctaactttgccaccattttagatttgcttacatagcttaagtgattacttcaaggccagtcacttaatctaatagaattagttgcagccacaaagtgttgtgctgagattaatggcataaacatctccactttgtctctaggttgatatggcagcatgagatcattatctttccttcattagtcctgccaagttcactggttaatttgatcattttctgtctccacagttcctactgactatagctacttgcctgaaagcagttttattggagcagctattggcttcttcattacaggaggaaaaaaaggcaagtgagcacatttcttgaattttatcattctatctccatgttgttataagtaaatttgtgtaccctaagcatgcctctgtagaatcaagcaatataaatctgaaggggtgaatattttcgtctgctaaaccatctttgcaatagagatgaccagcagctagctacaataattggtacgtaaatatacacattgtgtggtttcttagaatcactgtctccgaccatgggtggctctgtgaaaatcttaatctcccatttggccctttccaaagtataagcacagattacttttcctatccatttcaagtgagtgtgatctagaaagagaaaatacacctgggtgcagtttctatcccgggatctgtcttgcaagtagatcttctccctgcatcttttataatcattctgtgttgttgaaatcactggctctagttcctatttttagtttgtgttcttttccttgcacacatttgagcctttgtgattctgtattgctgccacccccattaaagtacaagcaacttgaagacagagattgagtgccttttgtttttaactggagccagaacagtgccatgtaacttattgaataaatgctccttaataatacacatatagttttcagggctgtgaggaaaaaatggattagaactgaacatgtcatggctcaggaatcagcttcgttaccgtgatattctttcattgatgggtttgctaattttattcttccttggctaggtcagtcttccttggttaggtcagtctgggcaaaatcagtgcctgtattatagcaagaccatcccaattttagaaaggaaaaaaataaacaaaaaaactggaaaaaatctggaagtggcagtttgatttgtgagggtcatggaagtaaaatgttacctttggaagggaagttaaatctgtgttgtctgatttcccactgggtacagtaatccctggagcttccagattttgaatattttcatagcctggagacaaattccattaatttctggagttctagaatttgtgctattattctagggtcctgaattagcatgatttacttatcctcagtaaaaattgacatatggttatgtcattgttgtacatgacatatttatatataaacagatcatatattacacgtaatgtacagttagttcattgtttatgttaccataaattaagtctacttaaaataaatattatagtagagatggcttcattaggagaaaattcttactaaatgagaatctaaaattttcatggccaaactagtgctaggaatacatatatatttctgctatattttttgttaggttgcttattgatatgaaattttaaaatgatgtgagatattttcatgagaaataaaagtaaaaactcttaaggtcaagtagaagatagactctttttcttttctagtgaataaaatgttagtctagctccccagatccatatttcttggcagacatgaattttctctgaatcttattcaatcttcggttgaatgtaacatttttatgattctgtagtcatcatacaacaggaaatgttctgctataaggctgaaaaatcaagtggaactggaatcagtgttgttatgtgcagtcttgctgaaagctgttttaaaacaaataaatgaagtattaagaatgccatattaccaatcagatttttggcattttcaggttgtgggagagggctgtcgtcttgtcaggtttgctgactagattcagaggaaaatctattcagccttacacattactaatgatgaccccagaggagtgggggccgtgggaggctgacctccgcctccaaagcccatttacaaaaacaaaaccagaccctgctctgtggggctaaatgggatggccaaatgcggaggtgtgcatgcaaacgagtgttttcttcttcaatatacccagctcatttgaattttaataactcccttctgaagcagcttttgagtttaaatgtctggatgtcactcatcagagcccggtgggactgctgataggaaggatggcaactttagtgaactcttttgaggaataaatggttttagaaaataaaaataatgcttagcataggcagaaaagtttagggatggcatggtttcattgtctctgcttgctacttttaacttcagcaactcactagaggaaagaaatgtgatgggccatccccaatccacatttgtgctaggatgagtttgggcatggtggtctcaaatttagccaatcaaatttgagatagtgaatctgttaatctgttttctaatgtttagggctttctcacttaggatactgactttagtactcatgtgatagaacatataagatgttcatagcatccattctttcatgcagacccacattttaaaaagatactaaatagatgagattccctcagtttttaaataattcaattcatggttttgactataactgggtctttttttttttttttgctataccatgtgacattcttctttcttctctcatagccctggaattcctctatcagatatattgttccttaatcttttgtcgtcattattatctgttcttgtgaacatttcttgactacgctagccttaaaatctttgctcatcatctaattcctcctaacatggatattttttccccctgaagaacctctgacttttgacttttacttttttgcttcttttctacttttattcttttgtctgatttctgattttctcaagatcataggctgttcatatctcatcaagattttatccacttcttttataatacattagaaacatatttaaagtacttaataaaagtgattctttctaatgctaatattagatatttctatgtaatagcattatttttgttattatattgctggggaatgtggctaacactttctaagcttatattttcctattaggctttaaaaattcacagtaagaagtattaactaagcaaagtatatttaagtccacgtaatagtcattatgaatggctttctttcttgatatgggctaattggtcagtgatctgcgtgtgtaagtattgggcttggatacgaagtacaggtaggcatatgctccttcagtcatttttgaactattaccatgagaggtaattgttaagaaggaaatatgccaagggaacagacttagtgaactctgagtagaataaataatacgagaaagctgtcctgttttctgatgaaatcatggagttggttgccaaggttatgtgtgatttttgagtattttaatttagaaatagtttacctgtacaactctttaaaaaatattatcagaagtcagtatatctgtataatactaagttaaaagtgtatatagaagaaaataagacaatcctctgtcatgtcaccacttggagatagccattataaatatgtccttcataatgtcctcctatatgtatgtgtatgtgttatattgtaccataaaatgtatattattttattgtcctattttaaaaaaagtaatgactttacatgcaaatggacataactagcacccatgtcttccaaaaaaagccttgaggaagtaagaaaagaatcctattgcattggtttctggacatttgtcaatagcatatgtttttggtgtgtttgattccttttttgtttcatgaggtttgttttcataaacctcatgaaaatgtttggaaggaaaaatgtcaccaattatcccatgactctacagctattatcatttctggatattacttaatttgctgcttctgggattacagccatgcaccaccacgcctggctaattttttgtatttttagtagagacgggacttctccgtggtggtcaggctggtcttgaactcccgacctcaggtgatccgcctgcctcggcctcccaaaatgctggaattacaggtgtgagccaccgtgcctggcctgtatttttgaacttaatattatattataaactttccctgttttcatatatcaccataacaattgtataataacagctattatttttgagacaaggtctcggctctatcacccagggtgaagtgcggtggcacgatcatggcttactgcaacttcaaactttctggctcaagtgatccttctgcctcagccccccaggtagctaggagtgcaggtacatacaaccaggatcagataatttctgtactttttgtagagatggaaacaatgttgcctagtctggcctcaaactctagctttgagcaatcctcctgacttagcctctttaattgttgggattacaggcatgagccactgtacatggcataatgatcatttttaaatgactatagaatatttcatcaaattcataagtcataataaacttaatcattttcgtattggtcatttttaaaatttcaattttagtgaacatcttttcttttcttttttttttttttttgagacagtcttgctctgacgcccaggctagagtgcagtggcgtgatctcggctcactgcaacctctgcctcccaggctcaagtgattggcctgcctcagcctcctgagtagctggaattacaggcaagtgccaccaagcccaaagatagatagatagatagcatagatatctctctctcttttttttttttttttttttttttttttttagtggggtttttctatgttggccaggctggtcttgaactcctggcctcaagttatctgccctcctctgcctcccaaagtggattacaggtatgcaccaccatacctggcctttagtgaacatcgttatgcatatagctctcttctgctacagctttccttcagataaattctcagtaatgtagtgagcaggagtccaaggatttggtgactatagggatggccaggcctcgttgcccttcaaaaagctttgccagttttcagtacctcagccctgtatgaatttgcaaaaatataaaacatagaggttaaaagcataggagtcaggctgcctgggttcatatcccacttccactacttactggctgtataacttcaggcaaactgtgtctgtaagctttgaccacttctgtaaaatggagaaaataattgactgttttttatagagttttgtaagaattatgagtcactttatgtaacagtacttataaaacaatataaagaataaattccttcttttataatgtcatattaaaaagcagcccaaaaaacaaatgataacaataaaaaccagtcaggtataaaatgataccttaagactgctctcatttgcatataattgccagaaggtctgaacatctgtacatttatttactgtttaagaggttggttttttttttaagtaaatttgaaatttttaaaaaaaatttttaattgatgaataattatacatattcatggagtacatagagatgttctgatgatattatgtatagtgatcagatcagagtaattagtgtgtctctcatctcaaacatttatcatttctttgtgttgggaacattcaattcctcctcctagctacttgaaactatgtattattgataactatactcaccctacagtagtatagaacactagaacttataccttccatctaattgtggttttgtatcctttaacaagtctctccttgtctctttcttccccctgctctttcctagcctctaagtattctctcttctactttttacttctgagagatcaactttctttttgcttccacatatgagtgagaacatgtgctatttaactttctgttcctggcttatttcacttaacataacgtcttgcatttctatccatgctgccatgaccagcaggacttcattctttttgagggcttaatagtattccattgtggatatataccaaattttaaaaatccattcatctattgttggacacctagatttattccatgtcatggctattgtgaatagtactaaaataaacatggggtacagatgtctctgatagaatgatttcctttcctttggatacctgcccagtaggaggattattagatcatattgtagttctatttttagttttctgaggaacctccctactgttatttatagtgggtatactagtttacattcccaccaacagtgaatgaattcccttgtcttcacatcctcaacagcatttgctgttttttgtttgtttgtttgtttttaataatagccatcctgactggggagagatgatatctcattgtggttttgatttgcattttcctgatgattagtgatgctgagcagttttttcatatatttattggccatttgtacatcttttgagaaatatctgttaatttccccatcttaaaatcagattgtttattttttgctgttgagatgtttgagttccttgcatattctggatattagtcccttgtcagatgaataatatgcaaatattttctccattccacaggttgtcttttcatgttgttgattatttcctttgctatgcagaagctttttagtttgatgtaatcccatttatttttgcttttattttctatgcttttgaggtcttattcataaaatcttgccctaggcctgtgtcctgaagcatttctcctatgttttattcctgcagttttatcattttgtgtcttacatttatgtctttgatgcattttgaattgatttttgtagggcgagagattggggggtgtagtttaatttttctgtctatggatatccagttttcctagcatcatatattgaacagactgtcctttccccactgagtgttcttgacatttttgtcaaaaatcagtttgctatagatatatagattaatttctgagttctctgttctgaatttatttttaaatttgtatttttttacccttttattttgaaacaatctcaaacataaaaaagttgtaaaatgcatagaaaagtagcaaaaattgtcttccttttttaatagtaagaaaaactccacattcctttcaaccaggggcactattcaagtttcatcaacaatcccagtgatgtttttaatagaaaaacaatctcatctagaatgttgctctgcacttatttattggtctctttggtctccttcaacctgaacactttttcagttttttctgtgacttcttgactttaacgagttttaagattagaagccagttagtttatacaatgctctttaatttgggtttgcctgatatttctcatattagagttaggtgggtcacttttggtagagtatgacagacgtggagctgtgtgcttctcactgcatcccatctgtggcacatgacgtctcagctgcctccactggggtggtgagctttgctcacttggataagatgttgtcttctaggtttctccactatgaacttattcttttacccttatttcaataatctttcatgtggagatgttttgaaatttcacaaatattctattttcatcctattttcaccgattagttttagcattcactaatacttcttgcctgaattattactgtgatggttgtcaaaaggtgatttttaaaaatccatgaatccatctattttttttttattatactttaagttctagggtacatgtacacaatgtgcaggtttgttacatatgtatacatgtgccatattggtgtgctgcacccattaactcgtcatttacattgggtatatctcctaatgctttccctcccccctcccccaaccccacaacaggcctcggtgtgtgatgttccccttcctgtgtccaatgtgtccaagtgttctcattattcaattcccacctatgagtgagaacatgtggtgtttggttttttgttctcgtgatagtttgctgagaatgatggtttccagcttcatccatgtccctacaaaggacatgaactcatccttttttatggctgcatagtattccatggtatttatgtgccacattttcttaatccagtctatcattgatggacatttgggttggttccaagtctttgctattgtgaatagtgccacaataaacatacatgtgcacagaatgggagaaaatttttgcaatctacccatctatgttttttattaggcgttctgctgtaagaaatggctcctctcctctcctctccactcctcccctcccctccgctcccctcctctccgctcccctcctcttctctttctctccctctctctctctgtgttagtgtagactcgtaaattcctatgttatttaactattcagttatctattattttgatctttaacttgtccaataaattgaacaaaatattaaatttgaccaataagaacctctacaagttggctcttgtgtccttttgacatgaccccctcattctttgactgcttcctttgtggcacaagaagatgtcctaggtttattttgtactatccccagccctgtaatagatactccaggtttcttttagtggagcatggtatttagaagctaacatctgtgtgcaaagcatctcattgctgctggggtaatctttgtctctaggccgtttcagtggacagagctgggaaacatatgttcttgttctctctcatgtatttttatttctgtatttagctatatatgtaataaaaagggttcaatctgtctttctttttgtatttgtaactcccttctctgacagtaagaaacttgactctcattatcctcaatatatttactcatttgcccaatcctcctggatgtaagtaatctcctgtccctgctggaccacggtcctaaactgccttcctcactcaggtctccactgggtgccatcctactttgtggccttcctgattttaagaggccttgggatatttttgcttttaataacaaaatgttattgaaatattcggtcttaacatagaaaacctatcaacctttagtgtctgtctgatgtatcagaatcatcaatttattttaaaaactgtcttgattgtagtttctttcagggggctaggcatctcctagttcccactaataggcaatgctgtaattctctctgcctgtgttttctatggacttagtgtagaaaaaaatcgtactcatccttttcatcttgatttaaatattctttccttggtgggggaagataggggcttccgtgatgttcccagattaagttagattacttatgtgatactttcctatatattttcatggtgcgtaatatatgtgtcatcattttcataattatttatacttctttgtttaaactctgtcttttccactaggtgtgatttcctcaatggacaggaagaatagctgtgttttatcgtaaatacttagaacagattggcatgtaatagttttctaatatttgtttatctataactttaaacatacacatatataatatatatatacacacacacatacatacatacatacatacatacatacatacatacactagataattctaagctaagttacctataagcagcatttagctggagaaagtaaagatatgtccaaaccacaaaagcaatatgctagcgatggaaaatatacagactcaggctgttagtctacttgttgccagacttttactctaaggattacacatgtgaattgtggcattgagatctgatcctctgtgtagccaaagtatgtgcgataatgggtcctgttgtaatgcattatgttcggatatactgtttatatcagggttctttgaggctgtcaactggatgagagatttaaagtaactttgtttccaggttttacaacatctggatctttttaacaagtactgttaggccttctcagttccaaatccattgtccgtaaagcatttcattatttctttttatctaaaaaacttgtttgaaagacaaagcattataataaaggaactgatcattcctgttgtttagatgtggattcttttatccagtgctaaagatctctggggaaggaactagttcactgtgttctcccttggctttgggactccctctctttctttccatacctcctccagaatgcatgaaactgccaaatattttctcaatttccaacagctactatagttcctctcattccagttagtgtctgaatcagttccctacaaatagtggaaaattttttgtgagtgtagttatactactcaatactgattctttgcccttttaaatgtggaagatttatttcattattggactgatgtgatttttcaaccctattctccattttacaaattttctttgttgctgacacttgcatgtatattaggtcaattctagcgaatatagaagcaacatgtaaagtgcagtactggtgaaagttgtcctgtcaaaggagagctcattatcttaagaataaaacgtctggaaaatggtcatatttcacatggggtcctggtattagaaggcaggctggacgccttgcctgtttccctagatcctctggaaactccaaagtctttgtagtggattctctcaaagtgcctggaaaaaattttttatgtaattttgaaaatactcaatctctgagagttttctaagtagaaatctatttatgaattaatgatttccagtgcagaattggatgcattgttcttaaatggagagatgtaattcttgcataggtatttactataatgtctgccagtttatcaaactatttctatgaatcatgtgctaagaaaaccccaaaaagcaacttaatttttgtgttttcttttttgtgaaatcaaagactgcaatctgcagccaatgttgtgtagagatacttagcgcatatgtgtaatcagcatggagttatgtgaatagacaaccagttaactcctatcacagcatttttttatcacagaagttattacacctgattttgccttgcttgtttcttctcacgttagaatataagctccacgagcgcagggacctattctgtcttgttcaacactgtctccgctgctagagtcagtacctgatacctaatagatactcggtaaatagttgaatgaatgagtgtgtttataaatgtatttactttatttgtcagaattttttttttccttacaatagcaggggttggccagatgtggtgtctcatgcctgtaatcccagcactttgggaagctgaggcaggtagatcgcctaaggtcaggagttcgagaccagcctggccaacatggtgaaaccccgtctatacagaaaatacaaaaaattagccaggtatggtggtgcacacctgcagtcccagctactcaggaggctgaggcaggagaatcgcttgagcctgggtggcggagtgagccaagttagtgctgctgcacttacttgcagtgaaccaagatagtgctactgcacttcagcctgggtgacagagtaagactctgtctcagaaaagaaaaaataataataatagcaatgattaactctctaaaaatatttcttgaactcccagtattacatctcaagatggaacagaactacaacaccaattactggtagcatagcacagaagagtggcaggtgtgttgagcatcaacatttttttttttgagatggagtcttgctctgttgccaggctggagggcagtggcgtgatcttggctcactgcaacctcttcctcctgggttcaagcgattctcctgcctcagcctcccaagtagctgggacaacaggcgcatgccaccacgcccagctaatttttgtatttttagtagagacaggctttcaccatgttggccaggatggtcttgatctcttgacctcatgatccatcctcctcggcctcccaaagtgctgggattacaggcgtgagccagagcatcaacatttcaacaaagtgaaagagtgtttgttggaggggagagaagcatcactggaaggcgcactactatacctgttggcaggagggagcaggttagtgggtcactagcctaaggaaatgtgctgatttttgagaaggtgctgatgggaaataagtctaaaatatgggagaaaggcctagatcagaagtatggatttatattcatcaacatataagtaatatttgaaactgtgaaagtagatgaactttcacagaggaagaacaccgaagcttaaggaagcagttatttcaggaatgagggcatggtactcttttatatggaaaagtatggaaagaaagactgagaaaatacccttgaatttggcttttagatggccattagaaatcttagccagggtagttttggtggagtggcagggccaatgtctatgtagcagttgtgttagggtactttttattccagaaagcaatgattctgacttcaactgactcacaaatacttgttgcaaggattctttggtttcacagaaatccaaagacagaaactttgtttttgggagtatcgagaacagaaagatatcaggcgccaagactgtatctctctttttctctttttcaggggctgcatggtatcagtttctcttgtggtttctacttttcttctaaagactcatccatccctttctaagcttcttatgctttttttggtgataaaatgtatacaacatgccattttaaccatttgaaagttttctgtggcatttagtgcatttacaatattgtggtgccatcacgactatttccagaatgttttcattaccccaagaggaaacattaagcccattgaacagttgttccccatttcccatttttccaagatcctagcaaccaataatttgctttctgtctttatgtattttcctttcctttaaatgtcatttaaatggaaccatacaatatgtggcctttgtgattggcttctttcacttggtgtaatgttttcaaggttcattcgcattgtagcaagtatcagtacttcattcatttttattgctgaataaaaatccattgcatgggtatgccacattttatttatgcatcagtttatggccgtttgggttgtttctaccttttggctattgcaagtgatgctgttatgaatatttgtgtacaagttttgggttgaacaccttttttcaattctcttggtgtatatatatatctagaagtggaattgctgggttgtatggtaattctgcttaactttttgaggaactaccaaactgtttttccacagtggccgcactgttttacattcttgcaagcaatataggagggttccaatttctccacgttctcgccaacacttattttccattattattatcattgccaactaattggctgtgaaggtggtacctcacgtgatttgggtttgcatttccctaatgactaataatgttaagtatcttttcatgtacttattagccatttgtatatcttcttggagaattatctgttcaagtcctttgcctatttaaaaaaaaaataaattgcctgttgttgagtcgtaagagttctttgtatattctggaaaatagacccttatttataatttgcaaattctgccattctatagattgtctttcatttacttgataataccctttaatgaacaagtttttaacttcgacagagtccaatttatctgcttttcttttgttgctcaggtttttaatgccatatctgtgaatccattgccaaatccaaggtcaaagatttacccctgtgttttcttctaggagtttgattggtttagtccttatatttaagctgttaacccattttgcgttaatttttgtatttagtgttaggtagggacctagcttcattcttttgcatgtgagtatctagttgtctcagcaccatttattgaagaaatcattctttcccccattgaaggatcttggcacccttgtcaaaaatcaattgggtataaatatatacgtaatttctactctcaagagtccagaaataaacctatgcactggtctatatgtctgtctttatatgtactaataccacgctgttttgattactatagctgtatagtaagattagtgtgcatgagttctgtacatttttcttttttcaagatatttttttttaggtatttggggccccttgcaattccacatgaatttgaggattgactttttcatttcagtggagaggactcttggaattttgatagggattgcattgaatctatggatcactttgggtagtattataatcttagaatattcagtattcgaatctgtgaacacaagatgtctttctatttatttagggctgctttaatctctttagcatattctaaacttttcggtgtataagtctttacccttggtgaaatctattcccagatatttcattcttttgagtgctattgcaagtggaattttttctaaatttctttttcagattattcactgccagaatataaaaacacaactaatttttgtgtgttggtcttatatcctgcaactttattgaattcctttattaactctattagtttttaaaaagattgtttgggattttctctatataggatcatatcatttgcaaatatagttttatgtcttcctttccaatctgaatgccttttctttttcttgtctaattgctccggttagaacatccagtacaaagtggtgaaactgggaatcctgtcttgttcttgattgtagagaaaaagctttcagtttttcaccattgagtatgatttaactgtgagtttttcacagtttttctttatcatgttaacatagtattatgtgtgttttttatcggaaaagggtgtttgtcaatgatttttctgtgtcaattgaaatagtcctgcgggcttttttcctttgtattattaatgttatatattaccctgattgattttcttatgttgaacaaactttgcattcctgggataaatcgtgtttgatcacagtatataatctttttaatatgctgttggattctgtttgctagtgttgagaatttttgcatctatattcataatatgtatcagtctctggttttccttttttatgatgtctatgatatcaggataatgctgatctcttagaataagttaggaaatactcccttctcctattttttgaaagaaattgagaaagattggtgttaattctttaagtgtccgggagaattcaccaatgaagccttctggtcttgaacttttctttgttgggaaatatttgattgctgatacaatctctttacttgttataggtctgttaaactttctatgcattcctgactcagttttgataatttgtgtgcttctaggaatttttcgatttaatctagattatctaatctgttggcatacattttttcgtagaattctcttgtaatcctttttatttctgcaaggtccatacaaatgtttccatattcatttctgattttatttgcatgctctttatgttttttttcttagtctagataacagtttgccaattttgtttatcttttctaagttccaatttttggttctgttgtttgtattttcttattcttttttttttttttttttttttttgggagagttagagtattgctgtgtcgcccaggctggagtacaatggcgtgatctcagctcactgcaacctccacctcctgggttcaagtgattctcctgcctcagcctcctgagtagctgggattacaggcgtctgccaccatgcccagctaatttttgtatttttagtagagatggggtttgaccatgctgtctaggctgtcgaactcctgaagtcaggtgatctgcccacctcggcctcccaaagtattgggattacaggcatgagccacctcgcccggcctgttttcttattttatacttaattatctccactctaaactttattatttccttcctctacctttgggtatatttgctcttcttttttaagttctttgaggcataaagttagggatattgattagaattatttctactttttaaaatgcctttttaaaactggcatttattgctgtagatgtcccccagtatactgtatttgtgcaattccataaattttggtatttttatttttattttcatttgtctcaaagtattttataatttccctgtgatttcttctttaatccattggtcatttaagaatatcttttttactttccatttattagtgagttttccagtttttttggaaatctgttcttgatttctattccattgtgtttatgaaaatacttggtatggttttagtcttttaaaatttattgagacttgttttgtggtctgacatgtggtaagtcttagagaatgttccgtgtgctcttgaaatgaatgtgtattctgatggtgttgagtggaactgttctagctatgccagctaggtctctctggtttacactgttgattaataaggatcctttatatcctcattaatcatacgtctagatattctatctagtattgaaggtagagtattgaagcctccaaccgttactgtagagctatctatttctcctttcaattctgtcagtatttatatatttgggggctctactgtttgatttgtatgtgtttctaattgttaaatttcttgattaatctaatttgaattgattccaactgagcatcaacaacatataaaaattctgctcttataaagttctatttctccctttcatgttattactgtcccaaattacatttgtatacattatgtgcccattaaggtagatttataatcattgttttatgcatttgccttttaagttacatagtaagtgaaaaggggagttataaaacaaaaatataaaaaaatatatatatatagatatataacaaaaatataatggcttttatatttacctatgtaattacctttaccagaattctttatttctttgtatagcttcaaattattatctagattactatttagtgtccttttattttagccttgaggactcccattaacatttctcgtagggcatgtctatgggtaacaaactccctcaactttgtttttctgtatatgtcttaatttctccctaatacttgaattatagttttgttggatacagcatttttcgatgacagttttttttttttctttcagtaaaaggtgttatcctgttccttactggactccatggtttctgatgagaaatgagctgttaatcttattgggaatcccttgtatgtgatgaatcacttctctttgctgctttcaagattttcagtctttgtcttttaaaaatttggctacagtacgtcttagtgtggatctctttgcctttatctttcttagactttgttgagcttcttgaatgtatggatttgtgtcttttttattaaattggagaagttttaggccattactttttcaaatattcattctgcccctttctctcctatccttctgagattcctgttatgcctacgttggtatgcttgatgtatccttaggctcatacttttcgtctttcttttttctctgtagactgagtgattttagttgacgtatctttatgtgagttgattcttttgcctgctcaagtctgctatttaatccctctagtgagtttttcattgcagttactgtactttttagagtacagaactctataatttgtttggttcttttaaaaaagaactctttttgatattctcttttttcttttcttgtattgttctcctggtttcttttagttctttgtccataattttctttagctgaatatatttaagagagttgctttcaagtctttgtctagtaagtccaatgtctttacctcctctgggacattttctgttaatttcttctgtgaaatgacaaagcttccttgtttcattttatgctccatatttttttgaaaactagacttttttgaatgttaaaattcagttttattccaagaataaaacaaaatattgtaaaatatgtaacataaaatttaacttttaaatatatgattttatgacattaagcattaatgtcacattaaacattaattaagcaataatcaccaccatccagcttcagaactttgaaaactgaacattttggatattgtaacagggtaacttggagtattacagtctttcttttcctcattgtttgttttcatttcttgctgtgggctatgttcagtgacttctcaaaattgtaaagtttgtctgtcttctttctctctgaaggctctgttcttttagccagtgattagctagtgctgacagagatttccttgaacaccagaagtcaaaaaaaggaaaacaaaaaggactctgccttttctccataatgtgattattacacattgcatgcctatatcaaaatatctcatgtgccccatgccccataaatatacacacctactctgtaaccacaaaatcaaaaattaaaataactctgctgccacttccacttctactttttctttatctctaccaattatgctgctatttctgaatatgcatcttcttttttaaaacattgtagtgataagtacacaatgtaaaatttaccctcataaccatttttttttattttttttggtgggggaggacagagttttgctcctgttgcttaggctggagtacaatggtgcaatcttggctcaccataaccttcacctcccgggttcaagcaattctcctgccccagcctcctgagtaacggagattacaggcatgcaccaccatgcccagctaattttttgtatttttagtagagatgagatggaatttctccattcaatagtgttaatgtgaatgtatattcatattgttatgaaacagttctccagaacttttcagaacttagaaaactgaaactctagccattaaacaataactccctttcccccacccctctccctatcccctggtaaccaccattccattttctttttctatgaatttgactactttagatacttcacataaatggaatcatacatttttgtgtgtgtgaatggctaatttaatgtaatggccttaagtttcatccatgctatagcatctagcatgattttctttttttataagactgaataatgttccatgttatgtatatactgcattttgtttattcattctttcatcagtggacatttgggttgcttttaccaattggctgttgtgaataatgctgctatgaacatgggtttgcaagatctcttcatgatcttgctttcaatttctttgggatatacacctaaaagtgaggttgctggattatatggtagttctagttataattttctatttatataaaataatgtgtaaatttttaaggaactgccatactgttttatatagtggtcacatcattttataatcctaccaagtgtacattagggttccattatttgcatatcctgggcaacactttttctggtgtttttgttgctattgtttttatagcaacaaataggttctaataggtataggctgatatctcattgtggttttgatttggtttggtttttttccttctgattagtgatattggtcatcttcatatgcttgttggacatttgtatatcatctttgggaaaatgtctaagttctttgcccatttttatatgctctctttttttctatgttactccttttttagctgctcttttttccttttgttgattctccctctgccctctctttttcagtttctagttgttctgcttttcctgctaattctgcatgtgcttctcttttctcctatgcttctttctgctgtttttcatttttctttctctgcctgctttttcagtatctattcattttgcttctgtttctctttttcaacttctgttaattctgtttctttttctgctgattccacatagcttctcctttttgcagctattttccttctgttgactctgccctatttcttcttccaccttttcagtgtgctgattttacctccgcttctccttgttcccatgcttctcctttctgcagctattttaccttatgctgactttcctttattctggttccctcttctttcagcatctgctgatgtggccactgctccttgttcctgtgcttctgctttctgcagctgatttacttctgctgactttgccctgttctggttccctcttctttcagcatctgctgatgtggcctctgcttctccttgttcctgtgcttcttctttctgcagctattttaccttctgctgactttgccttgttctgattccctctttcagtatcatctgatgtggcctctgcttctccttgttcctgtgcttctcctttctgcagctatttaaccttctgctgactttgccttattctggttccctcttctttcagcatctgctgatgtggcctctgcttctctttgttcctgtgcttctcctttctgcagctgatttacttctgctgactttgccctgttctgcttccgtcttctttcagcatctgctgatgtgggctctgcttctcctttttcccatgtttctcctttctgcagcttttttttttttttctgctgactcttgcttccccacttttagcatctgctaatttggtctctgcttctcctttttcctatgcttctcattcctgctgctgttttcacttttgctgactctgccctacttcccccttcttttagcatctgttcatggcctctgcttctcctttttcctatgtttctcctttctgcagctgtttttttcctgctgactcttgcttccccattttagcatctgctaatttggcctctgcttctcctttttcctatgcttctcatttctgctgctgttttcacgtttgctgactctgccctacttccctcttctttcagcatctgttcatggcctctgcttctcctttttcctatgtttctcctttctgcagctgattttttcctgctgactcttgcttccccattttagcatctgctaatttggcctctgcttctcctttttcctatgcttctcatttctgctgctgttttcatgtttgctgactctgccctacttccccctactttcagcatctgttcatggcctctgcttctcctttttcctatgtttctcctttctgtagctgtttttttcctgctgactcttgcttccccattttagcatctgctaatttggcctctgcttctcctttttcctgtgcttctcttttctgctgctgttttcacttttgctgtctctgccctacttcccccttctttcagcatctgttcatggcctctgcttctcctttttcctatgtttctcctttctgtagctgtttttttcctgctgactcttgcttccccattttagcatctgctaatttggtctctgcttctcctttttcctgtgcttctcttttctgctgctgttttcacttttgctgtctctgccctacttcccccttctttcagcatctgttcatggcctctgcttctcctttgtcctatgtttgtcctttctgtagctgtttttttcctgctgactcttgcttccccattttagcatctgctaatttggcctctgcttctccttttccctgtgcttctcttttctgctgctgttttcacttttgctgtctctgccctacttcccccttctttcagcatctgttcatggcctctgcttctcctttttcctatgtttgtcctttctgtagctgtttttttcctgctgactcttgcttccccattttagcatctgctaatttggcctctgcttctcctttttcctatgcttctcatttctgctgctgttttcacgtttgctgactctaccctacttcccccttctttcagcatctgttcatggcctctgcttctcctttttcctatgtttctcctttctgtagctgtttttttcctgctgactcttgcttccccattttagcatctgctaatttggcctctgcttctcctttttcctgtgcttctcatttctgctgctgttttcacgtttgctgactctggctccacatctgcttctcccatctttcagcatctactgattctgctactttttctgatgattttgcctctgcttctccttcttcctatgcttctcctttctgaagctgtttttccttttgctgactctacttccacgctgattccccctttttcagcatcttctgattcaggtgcttttttgctgatcctgcctctgcttttccttttcctacctctacttttccttttgttgattctgcttctctttctgctgatgctaatttcctttctactgccgatgttgatcctgctccttttgcttctccttggtcttctacattttaatgtgttatactatttctggcctcctcgtagtttcacgtttacatggcccttaatggctattctattcctggttgcaccatatgtttgcactcacaaatgctctactatctgtttttcaatttctaattaccctatacacacttcctttaaataggaatataatattaaagtaatggtactatgtcataggcagctggttaactgatggactagctgttacacagcccttagatgctcacttctagaacggtcaccatggcacaggctgggaagcagaaaaactagagactcccaaggtacagaatgcagtctaggactacagagactaggcaatacatagtccatagaatggagtgtacctgagtgagcagtccttattctctctgctggaagtagattgaggtgtaagtgagcaatgaggtactaatgtaaaagaagttacttaatttggaaaactagataaaaagacaagagtgtgcagaggacagctaagtagcaacgtggaaaatttttatccagtcagaaaggaaagactgtaggcaagtgaaagaatgaaatcatgtcatttatggccacctggagaactcatgttaagtgaaacaaaccagccacaaaaagataaatatcacatatgtggaagctaaaaaagttgatctcatatgcaatgccaaagaaagttgatcttatatagaggtagagagtatagaatagtggttactagaggttaggaagagaaggaggatggggcaataatgagggattggttaaaggaaacaaaatgaggaataagttcaaatacggggaataagttctggtgttctaaagcactgtagggtagtgactatagttaacagtaattgttatttccaaatagctagataaaaagattttgaatgtttcagcataaagaaatgataaatattggagatgatggatatgttatttatcctgatgtgttcattgcacatatgtatggaaatatcactctataccccataaatatatacagttattatatattattgaaaaatttataaaaattttttaaaaagagaagaacagagggagcaagcttttctggcaaatggagttgaaattaagagcacagaattgaagcgttgatcgcaattgaatatgtgatatcagatcctttgatgctagaaggaaagaaggaattgttggcattttccacttccatgatagtatgcaggtgttttactattatttttcactgtctgttataggtcctgaatctgtgcctccttcccttcttaaagtagtgatgaaacccatagcaactgttggagaaagctaccaatatcctcctgtgaactgggctgcacttctctctccacttatgaggctaaattttggtaaatatcatgtgtttttaagtcttcagactttgattttagtatttgacctgaatggaaaaacagattctgtgtcacaatgtgtagtgactggatagacttttcagatcttgaggtttgtcatgttggatggaatggctgggttactttcactcagtcattgagcccctgagggtgaggaagaagaggtctaaagacacaggccagatacacctgccaaaaacaatgcttgactgaggtttgcgcactgctgggaatgtggtacaggttccattaagcttgcctttgtggttatcaaactacatttccagagccataggtttcgagaagtaccatgtgggatgctgtattaattttctattgctgctgtaacaaattaccacagtggcttgaaacaacacaaatttattatctttacatgtccataggccagaagtccaacatgtttctcaccagcctaagatcaaggtatcagcaaattagaatttctttctagaggttctagggaggaattcatttccttttcttttctagcctctagaagctgcccacattctttgacttgtggccccctttctgcatcttcaaggcaagcaatagagggctaagatcttctcacaccatcatctttctggttctctgtagccaggaaaggttttccaactttaaggactcatgtaattaataggctcacttacataatccaggataatctctccatctcaaaatccttaaccttaatcacatctgcaaagcttctttgtcatataaggtagtgtattcacaggttgcagggatcaggatgtgaacattattggggaccattattctgcctaccacagttattttgtggtgagaggcaaacagaatacacacctcaacacctccagttcatccacagcaacctattttatacagaatagagttacacatgcaaatataatttaatgtacttgttccccaccctaactccaaaaataaagtaagaaggggagatgaagagcaatttaaacagtgttgtaaaattgtgtgtgtttgtgtctgtgcctgctgtgagtgctctatcatttatagtagagtgcatacttacatatgatatataaaacaacttctatactgtaatttatgtgtggtttcagagataaagataattttgactacatacaatttttcacttaagtgctttcatataaacctaatctctatataagatataatgtcaccatactgggtttccagagatttcatttgaaaaatgtgttccgctatccctctccttgtttggtgtgctatattgaaatgtttgtgtttcatttaagtccttagagaaaggaaggaaaataaggtgctgattggaatcttattactagaaaggcttgatgactagagaatgtggctctatctttaagccattccacaccttgatatatttcttcatggtctgcatatgagatggagagaagggaaaaacagagatccagagattactagctagaattttctcatattttagatagtgtttgagtgtgtagtttcctctggatatcataagagaaattcccatatctagttcaagcccattgctagttccaaggtgggactgtgatgccattggacatgttattttgcctcataactaacaagtctcttgaaatatctcttctggtttactgaagttctgttacctgcaaaagtcacataagcagatgctttgatttgagatattaaagcctgaaaatgagtcaggaaagtaactatatattcaattcttttcctttcttgactttcaggtgaagagatccagcaactgtgccttgaaattatggtgacccaggcacagtcatcccagaatgcagctgcactattgggcttgtgggtgacaccaccactgatccacagtctgagtgtatgtagtaactaagggtgttggccaacaggaggatattgttctttaggaggatattaacattcatttgggtgtgtgttctcaaagtcaagaggagacagatgagatcttcacaaaaatcgagggtttgatagtagctggcctgcatattggaaaattatatagttcagaaccctgccatagccattaccgttcatgctttagctaccatttattaccaaaagtggaaaatgatgatcagagatattaaagttcctttctcaagatcatatagctagaaagtggtggaattatttgaacttatgtttatttgattatatagtatatgtaattatttcagtacatattaagagaaaggaaatccatatgtaccggacttatccatgtattatccttcccctttcccagaggaggcagcaattaaggtgggccatgatttggttaggtatcacatcaaggggaccaggggatgtaggtgggagagtgtaagtggagagcatgaaagatctctactaggctgtttagcttgagcaaagcgttgagaaagcaatgaccgagtctggtgtttttgatagagggggctagcacctttcacgtataggccaagggcagataggaagaatagggcaagagagtttaaagatgtaaagttagtaaagatgtataattttgattaggtttcaaactagaacagaaaaacatattccatgattctttagaggtttaccagttgatgtaagttaaatgctgtcatcttttaattgtctccataatctggactattcttctgtcctaggaggctttaattgtttgagaatagtgcaaagccctcttatcatttcctcagtctcttggcctttgtccctattcagccttgtttctgtttttttgttgttgtttttgagacagtttctcgctccatagcccaggctggagtgcagtggcagaatctcgactcactgcaacctccgcctcctgggttcaagtgattttcatgcctcagcctctcaagtagctgggactataggtgtgcaccaccgtgcccatctaatttttgtatttttagtagagatggggtttcaccaagttggcaaggctggtttcgaactcctgacctcaagtgatctgcccacctcagtctcccaaagtgctgggattacaggtgtgagccaccacgctgggcctgtttttgtttttttaaacctttcctactcctcctcactgtctttaattgaaagtggatgttatcaaggtctgcatctttctgtcaggtattaacttcattccacctgtctgctccaagtggctcccagctgcctgccacttactgagcccttgctgtgcacctggtacctgcaagcactcagtgagtacttacagaaatcagacttaatttctctacagcctgacgggacagttttaaaagtagctttgttgagttataatctatatagcctaaaatatggctgttttaaagtgtaaaatgtgatgaatttgagtacctttacaggtttttcaatcatcaccaagaatatttccatcacctgacaagttccattgtgcttgcttgtagtcattccccactcccagcttcagacccaagccaccaccaatctgctttctatttgtagtattgcctttctaaaataacctttatttatataattttatataaattatatataaatttcatataaatttttgaaattctttagaatggaattatacaatatgaatttttttatgtctgtcttgtttcatgtctgagagatacattttattatttccattttaacagaattataaactgaggcaaatggaggtcaagcaaagtttgcctagctaataaaagagagagctctatctatctgagttcaaagccctgttctattcactccttcttacttttgaatcagacctatttccagcctgttgggttggccttcgaaattttcctaaattttacttatcctttcatttatcttttagatctgtgctactctgtgcatttgtctttgattatttatctttattgttatcttggttaataaattaagtttgtgagttcattttcttaaatatagaatgatctgagatggcatattctttaaaatgaggtcttgagaaaactcatgcaactacactgatctttttagaaatttgcagaaaacattgttcctctgtccctcccctatttttgtgtgctatcttgaaaaaacaaaaatagcacacaaaaaagtttttgccagattttactttttagatcacttattttgccagattttatttttagatcacttattttagacttgctgcccctttagtagcatgtttatgttcctaagaatttttgaagcccacttggttgaagtctgtcatataacagagctgttactaacatgccctttcttggctctcatgaactctaaggtgcctggtcagttctacgtgctcagctggtggttttactttggtcataaatggtcccagcatgtcacttctccttattacttccttattttttctcagaagaagaaattaatagtatcagatgctctgtttagttgattttcagcagttgagcctttcatcttccagagcttttcttgccagagaatgtgaccttttaaaactgaaaagtaactgtcatgtactttcagaagtagcattttattcccgtcactgaaaccttgaaaacatccaaggtttaagctgagtagttcacagatgggttggcagatcccatataaacacatgattcaccctggatcagaagtaactgcagaagccaaaattacatgcattggtggcccattggaccgtgaagctgtgggaaaatgaagggggaaggaagtaacctgaaccttttatctctcagtctaccctcaaacacagtgatgatgtacaggttttgaacattgcaaacccagacttgcctatttacattcaaccccttctgttttacttccagctgaataccaagagatatctcctgatatctgcacctctgtggataaaacacatctctgatgaacagatcctgggttttgttgaaaatttaatggtggcagtttttaaagcagcttccccacttggaagtcctgagctatgcccaagtgctttacacggtctgagccaggccatgaaactgcccagccctgcccaccacctctggagtctgctctctgaagctactgggaaaatttttgacctcctgccaaataagattcgggtgaggaacaaaaatatttacattcctgacaatttatgtttgggatattttaaaggcttcttggcaaagtggggaggtgtatgttttaagaatgtgggtgggaaggctagcaagaaataaccacattctttactaggagtgtatttgtttccaagatctaaattgaggttgaatatttagaaccaaagttttgagcaagcttagaagcagtttaaccagtgctgcaccaggaaatttgctattaggcgtttttaccaaatgcctcttgtagaagacgagaaggctcagaagtccttacgctttacacctggagaatccgtgggcatgagttcccatatactgtttatataaaacaatttagcatcgcccttccctcccccaaaagacctctgaattgtaattttacaaagaggttagaaatttatttgggatgaaggaattttgataaggagaaaaatgtatagccaaaacaaaacaaaacaaaaaaacacaaagtaacaggaaagatgtcttcaaaatgataaaaattggccaaatgttttggtttggttaaaattaaaatctcatcagctgctgttcatggggataagaaaatctaataatttgtcagaacattttgacctgttattttacactgtttgttgacatgtttgggatttttctttatcagagaaaggatctagagctgtatatcagcatagcaaaatgcctcttagaaatgacagatgatgatgccaatcggatcgcccaggttactaaggtaataacatatctttctataccttttttcattattgagccagaaattacgattgaataattgatttcagtgtttggctgaagcaagttttgcttcatttttgttattggttaatttcaggaaactatatttcatttacattgttgagcctcttgttcagcctactaatgtggttggtgcttaacaaatgttgtatggatggatagatggatgaataactttttaacccgatttctcccactttgtccttcacctgatcctatccttaggaatgaagaaggtggttgattgaaaagcaagcactattagccctgacacaggataatttatttcccacacccatgcccaagtcaaacgatgaatgagcaaaaagtagcatatcagtaaagttgccagatttagcaaacaaaatgcaagatattttgttaaatttgagttgcagatcaataatgaatcatttcttagtacaagtacatgccaaatgacacacttgtatttgaatggcagttttgcataccaactaataccaatggtctagagaactgtgagctcccttatagctggtggacttcgtgtcatttattttactttatggcaggtttgcctattcaatcagatccttgaatttctgcatcatatggcagtggttctcagaatgtggtctttgcataagtagcatcagcatcgccttggaaatgattagaaatgtgagttcttgagcccccatctaggcctactgaatcagaaactctgcagacggagcccaggagtctatgttttaattgtctctccaggtgattctggtgtatcctaaggtttgaaaaccactgttaaagaatatttggggccaggtgcggtggctcacgcctgtaatcccagcactttgggaggccgaggcgggtggatcatgtggtcaagagatcgagactattctggccaacatggtgaaaccccgtctctactaaaggtacaaaaattagctgggcgtagtggcacacacctgtagtcccagctactcgggaggctgaggcaggagaatcgcttgaacccgggaggtggaggttgcagtgagccgagatcccaccactgtactccagcctggtgacagaacgagactctgtctcaaaaaaaaaaaaaaaaagaatatatggaatatcaacattttggaagttaggttgttttaagcaaggagaagcaacataagaaaatagttaagaggatggactctggagcctcactgcttcagtttgaaatccagctctgcaatttgctagcaatgcgatcttggttaagcttcataagctctctgcctcagttcccttatctgtaaaggagagataataacacctatgacttagagctcttttgagagttcagtgagttagtccatgttgagtatttggaatactgcctgggtcaagataaggactcagtatttattatcataattattacatatgtgtaatgaattatatcctattattacattcatgtaattggaaataaagtatgtcatttacttcttagtacctagagctgaaggttgctgttactcgcttgagtttctacctaaaataccattcagaacattgtcactggaacatactaagtagtgttctgatgtccccaaaagagttagtctgcttcagcaaggtcagagttttctatttgtttctgaaaagaatagaggtagaggtaagaataagatagtggtagagaacacagactccctcagttctgtttcttactctgccacctgtagctatgtgaccttaatttaagcaagttgcttaaccactgtgcttcagtttccccatctgtaaaggtgggactttaatagtgatctactgcagagaattggtgtgagaatgagtaaatacagcagttctcaaatgttttagtctcaggaacactttagcttcttaaaaattgttgaggatgccaaagagcttttaattataagggtcatatctgttgacattttccttattagaaatttaaagactaggaaaacttttaaatatttacttaaaagcaataataagaaacccattatatatgaacatgattaataaaaaaatttaaagcataaaaatttagtgagaaaagtggcattgttttacatttttgtaaatctccttaatgtctggcttaatagaagacagctggattctcatggcagcttcttcattccatctgttgtgaggttgttttggtgaagtatgtgaagaaattccagcctcatacagatatgcaggaggaaaagggaaacgtgtgctaatagtcttttcacataattacggacatccttcttttacatttcaccaaaaaactcaacaacttgtagttccttttttaaaaaaaatattttttagactgagtctcactttgtctcccagcctggaatgcagtggcatgatctcaactcactgcaacctccgtcttcagggttcaagtgattcgcctgcctcagcctccagagtagctgggattacaggcatccaccatcatgcctggctaatttttatatttttagtagagacagggttttaccatgttggccaggctggttttgacctcctggcctcaaggtgatcctcctgccttggcctcccaaagcgctgtgattacaggcctgagccaccatgcccggccagcaacttgtagttccttaaaggttagttgcactgtagaatctgaaaccatattagtgaaactcatatactttgttacattaaattccacaggtctgttttacactttgggtcttttacccatgcatggttttgtaatatcatacattggtcatttggaaaatattgaatcactgagttttgaagatcttccaaatgttgacaatataaaataatcgtattgttaatagcactaccaatctcatcagaaaagctttttacatattgggaagctgccaggctcatagaagcagaaacaaattttccaaaaatctaattttctcttgaaagctcaaattttatcatttgggagcaaatactaccaggtatttttcttgaagtgacaggttcatttccttcagtttcaagaaaataatctgtcaaatacccaggttgaataaccatagtttttccatcaattattctttcaagtaaatagtgttctgtgaaaagagtggctatttcacagcctaatcttacacgtgttcttccttggcttgagaccaccatcatacctgggtatgcagcacagttcccatatgagtatttctcagtttgtcgcacagaatatttttaaaaatatttactcaagggccaatgtttaatggaactaataatttttattgtttacaaggatattttaagtgaaattggcttgtgaaaaaaaaataaacgtcagtacaatatacaatgaatactagtacactttggtgctaacataaaaatagttttgacctcacagaacctcttatgtatcttggggttccacagaagttctgtgtaccatactttgaaaaccactgaattaacacatgttaagtgcttggagtgatgcctggcacacagtaagtactgtatttgttagtcatcattttattattattgtttgtgtatatttactatatatcatcactgactaactcctgaacaaatttatggttttaatgaaggagcaggagatggcattacaaccctctattgtatgctcatgttaatttagcacacaggcagatgggtcatgtgctgcaggaaatgaacagaatagtaacatccaactcatcttttttgttttgcccttgccctgaaattctgtagctacttcagttaatttaatagtaactaaacaatttttttttttttttttgcagagcaacatagaaaaagctgcctttgtcaaactgtacttagtctctcaaggacgattccccttggtgaacctgaccgatatgctgagcgttgctgtgcagcaccgtgagaaagaggtgttggcctggatgattctgcacagcttataccaggcacggattgtgagccatgccaatacgggtgaggacaccctggggtgaacatcagaaacaggaatagatctgcctgctgttgcttttaagttgcacttgagttctcaacttaaaaattagtttagtgcttattgacacaggttaggccttctggtgccaaatgaggagtaacttggatagaaattaacagttatagctcacaacatccactttttggaaatgaggatggattctttcgaggggttttgttttctatttggctctgtagaccctcacagttacaaacaagttagctgcttctgcctgtttaacttcagtttcccaaaacacacaagatatcaattgattctgcctgatgatttcatgaaaatggcttttgggtagtcatttaacaaacaagagaaaacagaaacaaaaaaattaactagttattttacagaagaacttctctgggatgagaataatcaaatcctgccaccctgtctgcattagcaagcttgaagctctgctaatgaatcacatgatgcaatttttagaccgttttagacgttatgctttaataattactgaataagagcgctcccccattgctctatccaggttgttggtcatatttacaatttctggagactacattcaagttctgaatggcaccaggctcctgaggggtagatgtggctgggaagcttgtgcgactctggacaaattgcttatgcttctgtgcctggttttccccatccatctcttgtattgttatgatttttaggaaaaactgacaaacacgattgtaatactctgcaagactgtatcgccttaataccagcccttcaggaggcaaggcaggtggatcacctgaggtcaggagtttaagaccagcctggcccacatggtgaaaccctgtctctactaaaacgacaaaaattagctggttgtggtggcgtaagcatgtagtcccagctactcaggaggctgaggcaggagaattgcttgaacccaggaggcaaaggttgcagtgagccaagatcccaccactgcactccagcctgggtgacagagcgagactgcatcttgaaaaaaaaaaaaaagaaattttgattcatcatcccctgtggcagtctgaaacagtttttatatctgcatttgtgcctttccactgaaaaatgaacctatgatgagaaactggactttttaactctaagccaaaagtgtatgtatcaggaagaaatctagtaggtgtttcaaatgaagcatgaagttacatgcaataaactgaaataaatttgatgttgcctttggttccaaccagaaccagccagctctcaaatgcagttcccgtttttgaaacatgtccttagtagtctttactgtgctgggaatcctcttttttaaaaaacaaaattaaaagggaaaaaagtcaatattgctgctaatggaaatataatggctgtattttgtttttctttacatgtctttgggttaggtttcctctgtgatttggcataaattgggaacactgaagcaaaggagaactataaaaacaaataattgtcaacaattcaacattgctagttagttggcatgccagatttctcctagtgtgtttaattttgagagagaaactccaacaaatgcattttatcactagtggtcagggagatttaaagaataaattggcttttgaaaatcaaagaccaaaatactgttatctgatgtgaataatgtcaaagaactctctcacaggcagtcacaagtctcgggtattgcaagggaacatgaaactggttaatggaatcctcaccaggtgttctgctttagttatgatggttgttactgatctgttttacatttcaaaggaaaaccatggtctagtaagaaaatacccttttcatttcaggcgttttgaagagaatggagtggctcttggaactgatgggttatattagaaatgttgcttaccagtcaacatcctttcacaatacggctcttgacaaggtaaaatctagaggagtagtttatagcttccttaaaatacagaacttatattaggttggtgcaaaagtaattgcggttttgccattaattggcaaaaactgcaattacttttgcaccaacctaaaatatatgctcccaaaagaggagcacgttgctgtttgcagcttttctttccctctttccttttattttagacacacttaatgattctctgatgccgcaagaaaactggtattcttaccaagctcttggagacacccaaggctgccctttgagaaatattttcaacaaaatatgtttcttgacagacagaacacaaaggacacttgggagagagagaacccaagctcctgtgtagctgggattgatcccataaaggatgtgggaatatagggctctggcctccacactggccagcatatggctaaaaatgcctgctttgaagaggttcctggagtgtatgcagataatcttatgtgtgccaatacttatgtgcatgtgtgcatatatggaggggaatttttatcacacctgcaaaattacctatgactcaaaaaaagtaagaaccgctagtattaggtttgggtaagtttaaaaataaaagattaataagacgaagacagctctttcctgctttccttcattgtgttgacttagctggcagctgtgcattttgtaatagcagaattttttttctgtaggcatgcttcatgagtattctgtttgctgtgtgagtcaaatttgcataacctgggatgttttttgaagttctgcccagtttttctgaagagttgtatgtctttttgaaattttaatttgtgagtttaggaattttaagagattaggaagtactttttaaactttttttgaacttgcgtgatctgtcctctttcttctgatttcctaagtttttattaactttctctgttttcttacaaaaaccttaaaacactgagaaaatacagataagcagaaagaagtgtagtttaaatcacagtaatccaactactcagaggtggctcctataatcaccatttctatgattgtctagattagtctgaaatctaaatggatagatcctggacaggtgtttaaaatgcatgaagaagctgggcacaatggcacatgtctatagtcccagccacttgggaggctgaagcaggaggatttcttgtgctcaagagttcaagatcactctgggcaacatagtgagaccccatttcttaaaacattttttaaaaaaaatgaagaaagacttgctcaaaagtagaatcagagtatacatatttttaaaaattagttttgcccacataaccataaatatttcttcattttgtaagctctttgaaaacatcaaaacagaggaatgtttggatcttgatgtgattaggaattgaataaacgatgtttctcctgaaatgttagagcgataataatgaaactgttgggtcttctgccttcacataaagggacttcaaaaatcttctaaagccccaaaatgtatcttcattaaacatggaaactgagtttactgttcagttcagttcctcttctgggtgggggtagggcaggagggactggttgggtgaaggggaagatgacattgcctcacgacaggggctgtgtatgtgaacatgtgttactttgaattgttaaaaaatatgacctaacgtcatttctattttcatcgtaggctttggacttcttcttgctgatatttgcaaccgcagtggttgcatgggctgaccacactgcccctctcctcctcggcctcagtgccagttggttgccatggcatcaggagaatggcccggctgggccagtaccaagcttccttggcaggagtccaatgcacagggtcactctgcaggaggttctcactctccttcccaatagcatggctctgctgctgcagaaagagccatggaaggaacagacccagaaggtgaggctggcagccacctgcttagcagggcaggcagccattgtctcttcagcagtttctactgtagaattgaggtgggagttaagtgcgtcttgaatcacaccacagactttcctacccagccccatatctcagccagatgcagagtctcagagattgaggctagcccaggctcggggcaactgctgattaaacaacaaggtggcagcttgcttacagctgggagtgaggtggaggaaaagtccatacttcatttattgaaggcacttgttttcttgatcctggggaggaaagggtgagtatgtctcagagctcagaatctcaaggtgagggtcgacgggaaggcaaattcaggattgcaaatcgtgtgataagtaagatacagtggtgatgagcaagggaaggagttgatcaacaatgcctgggtgggtcaggaagttttctgccaggaaatgtgggtcgggagcatccatcttcttgtagcatctttaaggttccccatagcttattccattgcacagatatgctccaggcacccagtgtgccctggtctgtgctagatgccaaacagagctttgtaaaggtctgatagtatcacccttgccctcaggaaaacctaaattgtttagtttgctgttcagtctagttcctcttctggagtaggggtggggcgggagaaggagttgggtgaaggggaagatgacattgcgtcatgttgagggctttgtatgtgaacatgtgttactttgaattgttaaaacatatgacccaaaaggaaacattttttggtttttaatgttgaggttccccaggctactagctgttctgcaaagcataactgtgcttactgtacttctcattatatgtttctgacctgtccttaatacagttggttgaaagattcttttttgaatctcatttaatcaaaactggatttttatgaagttgaaagcttcaaactaacttttttttgcttattcttgaaatctgaacattaatctttaaaaacatttctgaactgtagacccatagtttagctatgcacaactccaccaagtatctcaactaaaatgccttttatttttcttaaacctgataagcattagtattgctgccccaaattttgtgctttgtgtcccatttaaaatcaaattttggctgggcacagtggctcacacctagaatcccagcactttgggaggccaaggcaggcagatcacgtgaggtcaggagttcgagtccaacctggccaacatgatgaaaccctgtctctactaaaaatgcaagaattagacgagtgtggtggtgtgtgcctataatcccagctactcaggagactgaggcaggagaatcgcttgaacgcaggaggcggaggttgcagtgagtcgcaatccctccgctgctctgcagcctggctgacagattgagactctgtctcaaaaaaaaaaaaaaaaaaaaaaatttaaatgtggtcttcccatatattatttctggactgggataccacgttccctttggactacaatgtagacctcttgcattgattatatatttgtagtgcttgacttttttgcttatcggttggatattatagcacaaaactgagaaaaggaaaatcaacaaagaaaaaaatttttgattaaagcagggaattaggaatattttctttttctccctattttactctttcttcaatctagcttctatatgtgaaactaaaatgcctattacctatcaccaatgtatgtgtttttagtgaaccaagattggcagcattcagtcattgattaaattaccctgtatctaattcaaaaacaattcaggctgcatcctgagagatcagccaaactcataaatactatgagtttccacctcatttgcaggatttattcatggttaacatgcttggctctacctagtgaattattttatgccatttctcttgcatttcaattttctgtttcatatccatttgggcacaactgttctcatctacagaaacatattttatttcagaaatgggggcttatatctgatgtgttttctatttactgcccagcctaggagcctagaccaagctgcacacagaaccaggtgggaggcagcatgatgcaaagaaagagcatagggctctgaagccaagtgtacttgggttcaaatcttaactcggctatacattgagggtggacttgggcaaggtttttaatctctctgggcccatcagagtgatgagagataatgttcctggcacacaggaggccctctgggcccatgtctacctccctcttaaaacctgtatcagcagccaggcatggtggctcacacctgtaatcacaacactttgggaggccaaagcagttgaatcacaaggtcaagagatcgagaccatcctggccatcatggtaaaaccctgtctctactaagaaaaaaatacaaaaattagctgggtgtggtggtgtacgcctatagtccccgctgctctggaggctgaggcaggagaatcacttgaacccaggaggcagaggttgcagtgagccgagattgcgctactgcactccagcctggtgacagagcaagactccatctaaaaaaaaaaaaactcctgtatcagctctcaaggtattcagcagggaagtaggtttgactttgccaggtcatttaactaaatgggagctgtatccaactttaccatatcttatgcttggtccctgtctcatctcctccacctggggaaggtattgcctaagaactgtaatcccagctactggggaggctgaggcaggaaaatcacctcatatatataggtccaagggaataactgttcttttgctgatggtaggattctcttctttgacactatttttcatttttaccctagttcattgactggctattcagcatcatggaaagccctaaagaagccctctcagcacagtccagggatcttttgaaaggtattacttccatgttttatgctcaacataggggaaaaaccattattgttgtctgtggagcagaatggcattctagtggttgcaggttgagtatctcttacccgaaatgcttgggaccagaggtgttttggattttggatgtttttggatttgggtatatttgaacatacataaggagatgctttggggatggaacccaagtctaaacacaaagtttatttatgtttcatacataccttacatacatggccggaaggtaattttatataatatttttagtaattttgtacatgaatcaaggtacttggtgttaagtacttatgtgtggaattttctacttgtgttgtcatattgaggctcaaaaagtttcagattttggaggattttggatttttagattagggatgctcagcctatattggtttctgaaagagataatctggagctgtttagtgtggcattttgaaccagaaagtagacttaaaaagaatgccagtccctttaaatttaccatttatttaaatggttttaaaatgttttatggtaatagtaaaatattcttttaattaaaattcagaaaattcagaaaactaaaaagcagcaaagagaaatccagagtcccattgcccaatgacaatttttatattttccataagaagttttttcctgcttctgtgtgtgttgtcttacatatttataatcatatacaattgaaaatacacatagctcaaatactgcctttttaattttaacattctttttcaaacatctaaacctgttcttacactggctttataagtagtgtttttaatgagcttcatagtatcttgccaggggaactagacacttctcctactttcaggcatttaaatgatttctgtcttttgtacttctctaccgactttgttaactatgactgtaggatccacaaacatggaagatctttccgtaaaacttatgtagattattttactcagatctgagaagtcatttgggcattggccgtatggactacaacagcttgttcttgtccttcatgtctggtgatctgggggtctggagcctgccagcagctgccactgaaactttcaccttcagaaagttgcctgttggcctattctgtgataatttatctggtcagcctggagtcagtgtatgatccatattttacctattactatggtacagtttattggttgccaaacaagtaagaattcattggttgtaatctgtctcctcaaagtggtgggaggcatgtgtgtgctgcaacagtgctcccacataactctgataaaccacagaacttcactgaaaatcagggctgtggtctgacatgttttcacattatccatccctagagacttgctgctagggcttactctgtttgacccatggagtttgtgctcatttttaatggccataataacgttggttgctccaaagatataccctcttaggttacaaagataacaacgcatatggatgaggaaagcaatcattcgggccaaggaagctcatattcacttgattatatagtaggcttattagattcacatacaataattgtgtaactctggcttacctacattccttcatattattatatttcaaataaaatatcaatacatttgtattaatattctaaaataagatataaaaaattacttaaaggaagtacacagaacttcctattttaaattgatccctgagggacctgtgacagatcagaaatagtttggggacagatgttcagatatactttagtatggtcatacttgctccattgagtacatgaacctaactttattataggttcaggttattcattgttgttttttatcattaagtaaatgtttaatggaaataccatattcatgtagaaaagagcacaaattgtgaggagatttttacaaagggaacacagccatgtagtcagcaccctcatcaaggaaaaaaacatcaccagcatcccagaagtcagctttcattttaattctgcagaatttcccattaactgattgcagggtaacttaaaaaaaaaaaaaaaaacaactttccccccaacatttataaatggttttctgccattaaaatcctgccaaaatatcgatggaactccctagtcttgaacattagccaagtgagaaaaagacaaattctgttctgacacctttttgatcaaaatgaccttttcaaatgcagccatacctatattttgtccccttagccaccctgctgtccttgagagttctcccagagtttaagaagaaagctgtatggaccagagcatatggttggtgaacagttttgcagtaaccagcagcattctcagctggatgaggaaaaccatataagtggaagaagtttttcagaattcatgcctggtattgctgagacatgatgcagagagttaagggtcatgaaaagatggccacatcactgacagcttgacacatgcctcctaagagaggagtgcattgctttagtacccgggccagttgagactgaaacaggaacttggattttctttatttggcttgagttcaatgtggagattttctttgtgaaagcttgaagatattatcttctccctgctaaattccagtaaaataatgttgtcaattttgtgcgtgtgacttttgttttaaggcatgggggaaggtgccagaaccacttggtgacaatggcattatgatctattttccatgaatctccatgaggatattcattgactcagtgagttagacaaatttccttattgataaaacactctcttggaactgctatacacatttaaataataagcataacattgaatattagctaaatcagattcattaatggtgtctatcatttccttatgctttgttctcttgaatgcaagtgaaagttgtgattccaaatagcttcagccaaagattagttcacaaactaagaaatttaagagtagatctcatctgacacagctgcatccagtgaatcaagtgatgccgtcaggctttgttcctctcagaatcattcctcatagctggcaagatgtctgccagtgacctcaaagggaaagaaaggtgtctgcccacagatacagcagaagcaacatgaggaggactctggttcagactggatgcctaggcccagggaggtcggtcacatgtgagtctctgagcaagtatctgggcccagggaggtggggaatgctaactgtccaggcctgggtcatatgtccactcctaagtctctggatagagaggtgtcaaggcagacccacccaaaccacctgaactgggtttcctccagaagaaagatgatggggtgctgggctggcaaaaaaatgacagatatctcccctgaagatcaattttttaaataagtacaaatctctttcttaatcggggtgactactggactaaagtaaatgcaggtttgtgacgatattctcaagggttgcattttattcaatggcttgagactcagccagcatttaaatttggtctatttgctaatgactctcctcacagccagtatctgggctctgtgtttagccaatcatataaacgtactgatgcatacgtatatgggatcactggaagaaaaattatgccactgaaataatgtacctttgtgtctgtcatgccatagcacagtgcctgatgctgctcaaccaccatggagcttctattattcccctgtggcctgtaccttcatgttgtcaccaatgtacctgccacttaggttaaaaatagctttactagttttgttttccaaatacatgacttccttagaggttaggctagaggaaaatgaatttgaatgaagacaggaagatagatagaaaatttactctagaaaccagcttccctctccttcccatctatatacactttcttatatttcctactgatgagaggttgaaattcatctaacattcactgctaggtgtcagaaaacagctatagaatatacacaaaacattcactgctaggtgaattcactgctaggtgaattctaacattcactgctcggtgtcagaaaacagctatagaatatacacaaaaggaaatgagaaaggtatttaaatgcttcattacaaaaaaataagcacaatagatgacaatcacgcaggaaatgagggacaaaatacctataaagcagatagaaaacaaatatcaaaatgacagaacagttgagctttcagttgtattatattatttaactcttgcaacaataccacaacgaggcattttctattttaaaatggtgcaaacacaactagttaagtggcagagaacccactgctctttctatgcaccaggctcatcagctcctcctttaagatgaaaactcccacagaggatgaaaccttactcatgcttaatgtagattgctataatcagataaagaaacaactctgcctcatataggtaggcctctggaacggagaagtttaggtctgtagtgtaaatgagtaggtcttcatgggttgaaggacttcagattcctgggccagcttgcaacatgaatggcaaacaggagtagtaaagaggaagtgagcaccaaagaaccactctctatttttttgagtctgcagccagagactaccaatgcccaagtaaagagatgaagaatcagcctagtcttccaaccccagactgcccttttcagttcagcccagtttcttctcattcaaactttgtccctgctcctgcccttgacaaggaaacagaagagtacaaaagggaggaaataagatgtttattcttttttccgcagctccttctttttattttgagcagccttgagtataagatttgtattttcttattcatgggaacctctaaagattctaaattcaaaactccaaaggttcttacatctaaacattctaagatatagatcaccagactaataagaccttttctcttgctatctgcatgacctcaggtgagaattaaattattcccttaggatttttcagtttattctccagaaaccagaagtctctgcatttttaggccagatgttcctagctttatggaaagtttccttacaaatcatctaatgttagtttttaaaaacataagtggccaagacaaatagcatgctgagatgtactaacaaattaatgtgtggggtttgagccctgataggtctctcagaactatctaaacactctgactcttgatttgaaaagtatacatttggaacagatgttaagatccatgcaagtgcctaaaatcctctttgtgttttatttgtaatgtaatggctccatggtaaccaaaaggctgttaataatctttttttaagttaactgtgagacattaatgtctccaaaatgattttaaccagagatagtggtattgtaattatataaggagtcagatttaaggattcaattactatcttgaagtaacttagtaactttgaaagcaagcagcagttttagaggtttagcaaacactttagtaaactgctgttttagaagagaaatcagatcatttggtaaagagatggggccttcgttaaagcccgagggtaggtccctgtttggtcagtttgtatttctgacccaaccagcctattcataggaaccacttcaaatggaactaggggacagagtgtggctggaaccgttcacattcttcatcactcttgtggaaagacacccaacagcatcatcttcgtttacgaatgtgtgtcatcactgctgtggtcctggacgaggtaacatgcttctgtattttctgggggaaatacattactgtgatcctggaaactttaaaatctcatcttaaatgtatgatatatataaatatatatatatattatttataaagttgtgagttttgcatttaatctgttaatcttcataaatagtaaaaacttctttaaaactacaacttagaaagctcatctgattcttgtcaaacatagggaacttgtaagatcatttccagctaaattattaaatatgaaactgaataaaaatgattattccctgaggtttggttttattttttggataaaatgatctacctcacaaagtagctgtgagggttaaaataaataatacaaaaatatggtttataaattataaaatgttattgaaatgttatcacttttgtgtgtttcactgcaaataaatagctgtaatgcttgaacacatttctgacatgtatatggggactcaggaagacagtggaagtttattaagaaattgttcttaacaattaaaatattctagaagtagcatgttaagatacttatataagttgaaagaaaaaaacaaaacttatgtgtcttctaaatataaggaacgctttgagatacaattgaaattcattacctaattaagccgatagatttcttgaaatatatttctagatgtagtagtggcgttctttaaagatagagttgcacacacaattatgggtgtctattatgtgccactatacaagtttctggggtacaatctgaacaaaacgtgtcatccctgctctcatggaacttacagtcagagaatataaatcactaaaccatcatgaagtaagaacagaacatgttataaatgtcctacttctgcaaagccctttataatttgcaaaagtttaatttaccatatgtcatttagtcttcataataactttaagtggttaaggaaactggaactcaaagagtcattcagttagtaaataatggagcttgatctcaaatcaaacctagtgctcttaattccagaccacattatctttcacaagaaccccatcattcagctgaataccatgaagtaacaatagacacctacatgtatgtgatgaattaaggcatacttttactaattgactttcatatggaattaactaaccttattttagatgagatttaaaactccagctacccttagcaaaaataaactagttagtaattcttacttggcatgttaaaaacatgttcagaactactatttaaggatttttaaagccataaaaaatcatccctgttctgaaaacattggtggcttttatataagtagttctttttagcagttttctttctgtccaaagctgaaataatttagactcaaaagcagtggttctcaaacttttctgtgcatgaggctcatttgaggagtctatcaaaaggtaggatcctgagcttattcccagagcttctgattcaactatctttagtggagccctggaatctgcattctaaacaggtgaacttgttaattgtggctgttgctccctgaacatacaatctgaacactaccctggagaaccatgtcatatcaacattagcatataactcagaccgagaagaatattaaaattatccgaaccaacgggaaacattataattattaaaaagcagtaataaacaagtggaagatagatactgggtaaaggaagataatttttagcatattttaaccttaattttaaatcactttaacactttagtaccataaaatgttttctccataagtaaacttaaataattgtaagattctttctttggggaaatattttggacattgagattgtatctatttgtacttctgaaataaatacagtttctcacatttgacaacttgctcaaggcaggcaaagtaaggaatagtttaaaaaaaaacattaacttagggaccttagtgagatgtagttaccatattattagattgaaacgttcagttttcagcaaaaaaataacaaggcatacaaagaaacaggaaagtatgtccctttcaaatgaaaacaaaaacaaaaactatctctgaaaaagacttgatggtggatccactaaaggctctacaacgactgccttaaggatgttttttaaagaaccaaagagcatgcggaaaaagtcaaaaaaccaatggatgaacaaaatggtaatatcaatatagagaaaatctaagacgatacaaaaaagaaattcaagagctggaaagtacgataattgaaatgaaaaactcactagaggtattcaaaggcagatttgggcagcagaagaatcagtatacatgaaaataggacaatggaaattattagtctgagcaatagaaaaaaattggaaaaaagtgaacagggtataaggatctgtgggacccatcaagcagaccaacatacacattgtgaggatcccagaaggaaaagagagaaagaaaggagcagagagaatatttgaagaacagccagataatgaccaacaaactccaagtagaatgaattccaagagatccacacaactatcaaaagccaaagacagaaagagaatcttgaaagtagcatgaaaaaatcaattcatcacatataagtgatccttaataagattatcagatttctcatcagaaactttggaggccagaatgcagtgagctcacatattcaaagtgttaggaaaaaaatatatcatcaaccacatttcctgtatttgacaaaactgttcttcaaacgtgagagagaaattaagacatccccagataaacaaaagctgagaaagtatgttaccactagacctgcccctgccagaaatgctaataggggtcctgcaagttgaaatggaaagacactaaacagcaactcaaagccacatgaagaaataaggatctcagtaaagaaaaatacatgggcaattataaaatctagtacttttgtaacaatggtttgtaactccactttttgttttctacatagagactactgcatttttaaaaattgattttggacacacagtgtatataattttgtgaaacttaaaggagtgatagacagagatataaagagcagaatttttgtatatttttgaagttcagctggcataagtccaaattaccttccggatattaaatgtcaccctatggtaaccacaaagaaaacagctacagaatatacacaaaagaactgagaaagatacttaaatgcttcactataaaaaagtaaactacacacaaaagacgtaatgcaggaaatgagggacaaaaaagctaagctatgtagaaaacaaatagcaaaatgacaggagtaagtccctccttatcagtcatcctcaaaaaggaagaaaattctgacatatacaaaatggaggaaacttgcagacattatgctaagtgaaataagccaattacgaaagacagatactgtatgattacatttatatgaggtacttagagcaatcaaaatcatagagacaaaaagtagactggtggttgccagggacagggcagatgggagaatagggaaccattgcttaatgagtatagggtataagttttgcaaggtaaaaaaagttctggagatggacagtggtgatggttgcacaatataaattacttactactactgaactgcacacttaaaaaggaataagatagtatattttacattttaccacaataaaaaaattactgaaaaaagttgtcttagatatgttttcaaaatatctaatggttcctatttcatctatgttacttagatttgagaaagtaagcctttgtctacactgtacaaaatgaaatagggatttggtgaacatacagttaagacagatagtcaaagacatcaactttgcgattttggtaacatccgattaaccagatagttactgtcttgacttcactatgtctgggtttcttaacctggggaacatgtacttaagtagaaaaagaaattacacctttattttcactaattgataatgaaatttagtattcctttccattgtgaatacaggcaaccaaccacagtagtattaacaattgtgtctgtcaccaaaggaaatgtaagatctttttatgttacaattgttgcagatatctcaaattactgtcaatcctcatttctgttttaaaataattataaattcacttgtgtttcttttggttttcaattttaagaagtttttaagttaatctggttttaaaaaattaaagcattatttaataatgaaattttaatttattataatgacccagtaaagtgtagtttctctaattttctctttgttttagtgattgattgtacatgtacttcggcagtgtaaggagccatctttatttggagtgattaagattaactcacctaaaatttgcaaagggtttatgttctccttgcacactaaagcttttcataatttttctgaaatttagaagataactataaaagcagaaaaaatgtagctttttaaaaggataattttttaaaatccaaatatatttataaagatttcaagtagcctaatactcaattgtttctttccaaatgttttctttagtggaaataagttacccatttttaaaattacatttttattatcctattcttacatcacaatatatttaatacctttttacatagtttctaggtaagatctttataattctttaccaaaaattgagtgatacatcaatgatacagcaatgactatcagttattcacactttttttagattttcaaagaaagcatttttcaaaactatgtaaggacatatgacttacattacagtaattagcaacaattcagtaataatccaaaacatgaattttcctttttaaaaagtacttagtatatttttataccttttatcttcctgtatgtgtgtgtcattatttttaaaattaaaaagaatacagaatggggcatcatttgtgtatttgctaaaggtttactattttcattagggtcttctcttttgagatagagtctcactctgtcacccaggctggagtgcagtggctcaatctctgctcactgcaacctccatctcctgggctcaagcgattctcatgcccccagcctcccgtgtagctgggattacaggcatgcgccaccatgcctggctaatttttgtatttttagtagaaatggggtttcaccatgttggccaggctggtcttgaactcctgacctcaactgatctgcccacctcagcctctcatagtgctaggattacaggtatgagccagcatgcctggccagggtcttcttttaaggcatcaaagcccaaataacttacaagatgttaacaaatacatgacattaatgaatactctatcagagcactagggactgaatgctggtgtcccccattaaattcacatgttgaaaatctaatctccagtgtgatggcatttgaagctggaaccttcataaatgggattagtacctttacaataagaaataagggagagatggtttctccctccaccatgtgaacatatagcaagaaggcattcatctgcaaaccatgaagaagaatcagctagcaccttggaacctcatcaggaacttaattgtctagcacctttatcttggacttccctgcctccagaactgtgagaaatatatttgttgtctaagccacccagtttatggtattttgttatagcagccaagctaagacagcaattagtaccaagaagtgtggtgatgctataaccaatatataaagatgtggaagcagctttgacgttaggtaacagatagaagctggaagagttttgaggtactagagtacctggaagagtactggaagagttttgaggtactagtttttttgctagaaaaagccagtattgccatgaagggattgatagaggtgattttggtgagggctcaaagagaagagggtgggagagaaagcctccatcttcatagagaacacgtaaatcaccatgaagataatgttggtagacatggacaataaaggccattctgatgaagtctcaaatgaaaatgaggaacctgttatgggaaactggaagaaaggtgatctttgttataatatgccaaagaacttggatgattgtgttcatgttctagtgttttgtggaaagtaaaattgtgagccatgaaattagatattgaactgaagagatctccaaccagtgttgaaggagtgcctcggtttatcttgactgcttaaagtaaaatgtgacaaaaaatgaagacagaattcttaacaaaaacggaaccagaacttaaaagatgtgggaaattatcagtctgtctgcattacaaaaagataagaaaacacgtttggtagagaacactaagagtgtagcagacaagtcatccaattagatttatgtgggtgtgaaccacagacctaatcagccaccccagcaggaacactgctagtttgtattgaaaggaatggagatgggacagaatgagggaagactgttggacttcttgaatttgggaccatagagctattcagctgtgaatgtacactattcttcaagaaaaggagaaactgacccggaacaatgattcagagaacatcagtggtaccttctcagtttcaaaaggggcagtcattgccttggtttcaacaggcctgacagcttccgcctggtgatatgggggtcatcctcctccaacatagtcctgggggcaatacctctgcctcactgggtcctgaagccagagtatcaggccaaagaggattattactaagactgaagatctcatggtgtttgccttgctaggttttggacttgctggggacccattacaccttccttttttcctgtttcttgctttgggaataggaatgtccaccctttgtgtgtcccaccattgtactgtggaagcacataacttgtttcatttcacaagttcaaagctggaaaggaattttacctcaggatgaattctaccttgaatctcacccacatctgatttagacgagactttggactttagagttgatgcaggaatgagttaagacttttgaggctgtcgagatggaatgtatgtattttgcatgtgaggaggacatgaattttgtaggaccaggtacagaatgctatggagtgaatctttgtgttcccccaaaattcatgtgttaagccctaacctccaatatgatggtatttggaggtggggccattgggaggtaattagatcatgagggtagagccctcatgaatggggttagtgccattataagagacataagagagttgatctctctctcatgtgaggacaaagaaggacatctatctgcaaactgggaagagggccctcaccagaaactgcattagctgatgccttgatcctgagcggaattcccagcctccagaactgtgagaagcgtttgctgttgtttaagccattcggtttatggtgttctattatagcaacctgagctaagacatagggcttggaaagatatttaattttctaaacatatctaatgtttagggtgagtattattagatctgaagacagacatctgtctatgaaatatgttattctaggcaactgtggaatatattttccatccctcttctcctacagatctatttgggaacttggaagtgaaaaagaatacatgtaatttaggttatcaagtttggtttcttaatttaattgaatctattgcagctaatctcctatttctcattaaacttacaggaaaataatcagacttcatacaatgtaagtataacttgtataaaatccaaatgaagcaggaattttggtgaagcagggtatggagaatatatatgtcttaaaaatacaatgtgtgaaaaacatagcctgttatgtctagagttttgggggtatgtgcagttatttcatgtaatggatttttatcaaatacaaggtatttttccaccagaatacttcctgtgttttatttactgcactgaatccacagcctgtcttttctcgtgtcacactggaatgctgtacttcacatcttcttttttttaatgggaaagattccgaggatgtctcttctttctgagtatagatgactgtaggtaaaatacatacctaatatggagaaagaagttgcaaaagtaagtaaggttaactatttctctggaagaaacaatgcttttaaaatacagtcagagtgctgcccaaatccagggagaagacacttgcaagggagatgtgagaaggaatgtttaaagaagtgtccagattttatgcagaaagagaggtaaatcaaactcttccatcctactttttttaatgcaaggaattgtcttcctttctttagcatagctctctccaccttcctctaaagtttcacatttttgtcttttctctctatatgttgttcatatgtttgatatctgttaccttctagagataatcattattttggagatttgtgaaggttagagctgggaaaacaaaaatttaatagtgaaagttttttccccaatttcctggaaaatgattaggtttaatgatcaaatttattcaagggtaagtttttgttccatacatttctcttgagtctgtaacaccgactcccatttgcctgataggaagtgccagcttgaaaagccaaacaaacaagaaacaaaatggatataaatggaaacatcagaaatagccaattcttcttagtttgacatctaggttttatttgtagatacctgtgcacatggtcaaaacttctatatctcatacataatgcagctatattttctgatagtaaaattgttcttatttgtacagtgaaagtgaaatatatgatcccatgatgccctgcaaaaagcattataacctccaggggctttactagcaagatctagttcatgatgtcaggcttcctctttggtctctcccatgtttaccaacctgtatattaaggtagacggcaagcactaaccaaaaagtacaggaaaaatgcaaaaacaagaccaaaaaagccacttacctataaagagcatcatgagatatattttcagcacatatgggaaatagatggataagtcaaagggcagcttggtggaataagtgccaaatgattcaaaataaggcagcgattgatagatggcaaatgctgttaaaaaagaaaggcatcataaaggtattcctccttaagttgttacagggatgtgtatatatgtcttcatagttgtaggatattttgaatttgataatgacagttttgtaatagttgctgaatctttttgctaaacctagtttaatatagaaatctgtgaaatgattaagttggcaaggtgcttacagcagtatgacttgttgaatgtttgtccatggtataccttattgtgcctacagaagaatttacaatgtttcttaaaatgttatctcaaaatacatttgtccacctagccacaaataggggtgatagagagatgaacttggaaaatggtgcatatattttcctcttagagtttcacaacacacattaacatagtagaacacatattaacattgtgagaaattctgtaataaaaaaataccacctagcctttcctcaatgtaactggccttagaatatctccttcttccttcttaaccaccagtagtatttaataagtattttgaagaactctatgagaaatgctggcctaaattattttgagggagggggctggtatcaggtaaaaaaaagattaaagttcagtaacattgtatcccatgtatagatatttttggtaacatttcatgcaatgaaatgttaatatgctaacatgatgtaagatgttatcattagggtaagctgggtgaagggtacatgggaatggtgcactatttttgcaatttcttatgggtcaaaattatccctacataaaaagtttttaaaaagagaaagatgaagaaaaggcaagagttcacaactgttagagccaagcagaggtatgagtagcatcagtgaaggatctgccactgacaccaaatatgcagtttaaggttaacacaggccgcacctatgtctctagcattttatcagtataattagttgattttgttatttacataagctttgtttttgtcttatatctgtcagatgggaaattatagttattaaaattattaaaattaaagttatcgaaagtttagtaggtttatttaactgcgcagttttatactttgggacatctaacatatacagaaacacagaaagataaaattacaattatctgtattccaccatccagagcattattgacatttttgtcatatatatctctagactattttctgcatataccttattttgtaattgcaagaataagtttatgaagttaataaaagaataagggttgtatggcaaccatataagaacatggctttcctagaaaagacaaggattagaattatggaataacaagaatgcaaaagtttcctatacatttatccaccccttattcctaggaagggattagtcatatttctaccttattcctttatatattcttttaaatttgattaagttttaattggcaaatcataattgtatacatatatgaagcacaatgtgatattttgatatatgtgtacaatgtggaatgattaaatcaagctaattaacatatctaccacctcgcttacttttcgtggtgagatttgaaatgtactcttggctattttgaaatatacattattaagcacagtcaccctgctgtgcactagatctcaaaaatgtattcctcctaacaaactttgtaccctttgaccaacagctcccaatttcctttctatattctctacagtactatgatttaacaaagataatgtatttgatatttcaatgagaggttacttgattcttaaagaatggacaatcaggttcttactgttttcaagacaattattctttagatccacttggcatagtctattccaaaattaataattcttccttttgaatcaaaacaaatttagaaattctaacatgatttacagtaacaagctctttttatctgctcatcagtagatagaaaatatgtgtttttgttttataactggcttttatatactttggttattgttaatgtcgtcatcattttatgttaaacaccatgtccttatgtttttcccttagttaccttaacatgctttcttattttatgtcttcagttttgaaaactttaatcatgtcttacagaatgctccttaccagtctaccaaatccattgcagaagaaagcatatattctccaaatatcctcaagctctgctgactgatgatctgaatgatttgatcttaagttttaggtttatatttaggctatataattagcctactcatactcaataattcattctgtgttcattgagcatgtatactggtgcataaaagagaggaaggaagcaaagaaacagactcagacatcctggtaccccccccccccccagagcttacagtctagtcaaggaaatggacattaatcaaagaatcatacaaatgtgtaattatgctgatataagccctgttaagacagcagtccccaacctttttggcaccagttactggttttgtggaagacagtttttccacagaccagaggaagaaggatggtttcaggatggttcaagcacacaacatttattgtgtactttatttgtattattattacattgtaagaacaaaataattatacaactcaccataatgcagaatcagtgggagccctgagcttattttcctgcaactagatggtttcatctgggggtgatgggagacagtgaaagatcatcaggcattagattctcataaggagcacacaacctagatccctcacatgcacagttcacaacagggtttgtgctccaataagaatctgatgcctccactgatctgacaggaggtagagctcaggcgataatgtgggcaatggtgagtggctataaatacagatgaagcttcacctgctagcctactgctcacctcctggtatgcggcctggttcttaatgggccacagactgggatcatggcctagtttgggggcccctgctataaaagattcatgatactgtacccaggggaactcagttgaggaagtcagggaatgcctccctcagaaaatgatgattaatctcaaggtagagttaactagttgctgagagagggtaggatacatagtaaatggtaagtgggaaagactcaccagaggggactgaatttctgtgcattaaaagttaaaaatcatagaatctctaaatgttaacttctttttggtgaataagcagactctgagaggttaaatgagttacccaaaactcacacagtgagttaatgaagtgaaggcctcagatgccgttgctttttgtccagtattttgtctactgtgcagagctgcttccctcttcaactttgcctctttgcatcaagggaaatatgccagtaaggatacactgagtgagctaagcattcgcaaaaatagtaatttaatcatcaaaaaatttagtgaaccattataactagatggcttttgtcagtaagcaatacagcaagtcactcttttcttaccttcagcaagaacacacaaaggataaattggcatccatagtgtttgactgagccatgtcaagacagcataggatattcctatgactgataacatgctataagtgtacctgaaaggagatgagaagctcataaacatcattttctgctaatatctgggaaataggagaaactactgtgtaattaaatacagagatacaactggaaagtgtacaaattgtatattttatttcctataatttaaggaagagttttttttaaatgggggaaagggaccatgtcaatctggcttgtctcatgtggtagatcattaataattataaagctaaacagagcaagtaactcttactccctcctcagaaaaatacagttacaaatttccttgattagtgacttcaatttcattaaaaagccaagctcattttttgcagcaagcagctaggttttttaatgacagacatacttgtaaatatctcaggaattcatttaaaaataaaatgtgacttccaaatctttatttggcatccttctgcttctgcagttgtactatctatgtgatcaattaaagaactggccttgggagctgatttgggtatagtagggagctttaagcctaccactgtgatgtaaaaagtagtctacgttgtgttttatttctttgaataggacactggtttttaggcttgagcatatatcagaatcacctagatggcatgttaaaacacagattgctgggccctactccaaagtttctgatccaatggaactgtggtacaccccagactttgtattaacaagttccaggtgatgctgatgccactggtctagggaccacactttgagaactactaatatagacagacaataaatacatatggcaaaactacccaaaaaaccttgaaaacatgaatggggaagagtaaatctctctcaatccaggacctgaattccacccctcagagacaatagccaatgtcagtttcttaggtattctttcaaaaatgtttttgcatttgcatatctatgtgcatatttactatacagaatatataccagcagtggaggacctcactgaacatagcatataatcaagctttttgatctttaccaatcaaagtgaaaaatggtatctcatctttttcccctcatattagaagagtgggtaagcatgttttcatgtttaaaagccacttttggccagccgtggtggctcactcactcctgtaatcccagcactttgggaggccaagctgggcagatgacctgaggtcaggggttcaagaccagcctggccaacgtggcgaaaccccatctacactaaaaatacaaaaattagccgggcgtggtggcgggtgcctgtaatcccagctactcaggaggctgagacaggggcatcacttgaatccaggaggcggaggttgtggtgagctgagatcacaccactggactccagcctgggtgagagagcaagactccatctcaaaaaaaaaaaaaaaaagaaaagccacttttgatgaagtccaatttatcttttttttcttttgttgtgtaccttataacacagccaaatccagtcatcaagatttactcctattttttttcaaagagtttcatagttttccacttatatgtgagtggttaacttcatttttttgtgtgtgtatatccagttgtcccaacaccatttgttgaaaaagactattctttccccattgaatggtcttggcattgttgtcaaaaattaattgaccaaaaatgtgtgagagtttatctttatcaattttattccatgatttatccttacacagtaccacacttaattattgctttgtagtaagttttgaaatgggaaagattgagtccttcaactacattcttctaagattgttttggctattctgagttcctggagtttaaatatgagtgttagggtcagcttctcaatttctgcaatgaagttatctgggttctaatagggattgcactgaatctacagatcaatttggggaatattgccatctgaacaatattaagtcttccaagtcatgtgggatgtcctttcatttatttagctctttaatttttttcaacaatgctttttcaacaatgtataaattctgtgcatcttttgtcaagtttattcctaagtactttattatttttatgctactgtaaacagaattgtattcttgatttcattttatggtagttaattgcaaatatataaaaataattcatttttacatattgataattttttatgtataagatgtcatctgccaatagagatagttttacttgttgctttccagcctagatgccttttataccattttgtttgttttctgttctgccttattgccatggatagaacttccagtacgatgatgaatataactggcaagtgtggatgcccttgtcttgttcctggatattaggaggaaggcatcagtctttcatcattaactatcatgttagtatggatttttcatagatgcttttttcaggctgaggaagtctcttgctcattacttaggaaaaataatgctagggtagggtgggatgataagtttacccccattttacagaggaaaaaaaagtttctaaaagttaggtgccttggaatttcactcctaggtataagggaaatgaaaacatgtgcacacaaaagcttgtatatggatgttcatggcagtactactcatggccaaacagtagaaaccacccaaatgtccatcaactgataagtggatacacagaaagtggtaaatcaatgcaatagaattttactcagcccaaaatgcaatgaagtactgcacatgccacaacacagaggaaccttgaaaacattatgctaagtaaaagacgcctgtcacaagaggccacatattggatgactccatttatatgaactttccaggataggcaatccatagagacagcatatgtgtagtttccaggggctgagggaaagagggagaggggagtgactgctactgggtataaggtttcttttatgggtgatcaaaatgttctaggatagtagtgatgattgcacatctctttggatatactaaaactcacaaattttgtattttaaaagggtgaattttatggtatataaattatatcttaataaaactgttattaaaataagaaaggttaagtgatttgcccaacatcacttagcaagtaagtagtggaggtgggtttcatctagagagatcttctacctctatgtccaaaaatcttcctatgacagcatgctacttctttcagtgcaaatgttgttttgttctccaatgtatttattgagcttctctgacactgaaagagtaagcatagccaagagtaacatactagaaagcttcaatcccaaatgatgttccattgtctcatgaacagaagttatgggctacaaaagtccatgaagtttgccccaagtccactaaactatcaattcaaaaatgaaaaattactaatttatatacataattaaattcattttacttcagcaaaagatttcattctaattcactctaggactcaacttattatttaaacatattttaattcagttaagttattgacaatataatgaaaaaatttacatacccttggctgaaaaacaaactagggctcttttgttacctattcaaatccagatctctcaagtaggagggacggttcttatttaggaaagctgacctagcagttaggacacctccccagagtgaggcgtaagcactcactgagcaaaggggactgtttgacaccaccacttgtagaggtaagactaggcacatctcactgcaaagttttagaattagcactaaaaggacttaagttagtcatttgaacccactggaattgtaaatgaatgtgagagtgcattttcttcctgagaggccctatatttaaaagattcttgaatgcacagaaactaactgtaaattctggtgatacaataaaagacctgctttgcttattaaagcaaccgtactaaagcaattgtgaggaatgcctttgttaggaaacagctgagggttattccaagttggttttatgccaagccttctgcagaaacctgaatgtgctgatttactcttgtaataccacggtaggttttcattatctttgatatgcccattatggagaacactaaaaatacatttccatatcaagataaaataatttgaaaaggggttatgttttcctctctcgtaccaagtaacctctggttactgctagtactggtttcactgcagaaagcaatttagccttgttttaagagattattttgccttcttacctaaccatatccaatagattccaaaagacgaataaaacacacaccacatatttctcttggacttcctcttgactggtgatcaccacaaaaaggatgattattctttctgtgagctaacaaagaaacagcaaagtcagaaattaggacatctattaggctatgtaggtaattttctaattttgaaaaccagatctcctttcaaaagtatactttagctggaaatatgtatactaaactgttaacaatgcctccctctgagagagtagggttatggctgaatttcagttcctcatttgtctatattttacaaataatatataatgaatgaaaaaatgacatatattttatgtgaatcaggatatttcctttcttcttgccacatgcatgtgtttctagtcactttgacaaggctttattgagtgtccactgtgtgtcagatgccaaaatgaaaacacagtctttgctccaaagagggtagcagtggtgggagaactgaacaatagccagcacagtgtgtgccagatatgggagcacaggtgagcgagatactttctgcctggagaaagaatgcaaagagattaatgaagacatgctacatttcatttcatccaagttggatcttgaaaaatgaataagagtttgtcaggtagactgggtataacagaaggcatcctaggcaaagggagcagcctgagcaaagaggcagaggtatgaaaatgtagggtgcccaggggagtaatgtgaaccactggggggctagaggggagggtgcatagaagggaataaaaggagatgaaattgaaaacatgtttggaggtgggttgtgaagggttttgaaagacaggctgagaaatttcagttccatccaatagagaaacttgtagcttttttttttcttttttttggtaggggagtaatataatcctaacccttataagctagcagaaaatgaaaagaattcaatatattccaagtcagcatttacaaatcattgagacttcacacatttttggcttagccccaattactagcctcaaaaaataaaaaaatacattcctttttcccaacctaaatataaagtgccttcttatgttatattaatatatcctgtacattctgtattttgtgtgtttttaataaaatgttttacttgctcttaatggtcaaaggaaaatatacttaagattgaacagtcaaattcacagtaaagaggggaatgatttatatttttctttattttaaaagtggatcaaggagaaaagactgggataacctgtgacttggcatttataggctgctagtcctggaaaatcacctagtgcccagaaatccaagatttgccaacagtgggccacatgatcagaaatccacgtgtataagctatatcagcatgtttacgacatgactacagtggtgagtcaagagggtctatgtttggctaaggggaattatatatgattcaaaccttagtcaaaccatggaagctatctacatagctgtttttcttttttcagtctttctttataatataatactctattgatttaatttcaataataaattctactgaactgcaattataattactgaacaatccaaccttgatgtcatgacacctctcagccttcagatacacgatcatagcaacaaataagttcttaggctctacctctcttacatttgatcagtgcttggttattaggaaaaccttctggtttttgctagaaatctcaggagatacacatacatgaatggatacatgaataaaatacagatttctaattacatggctggctactcaaaaaacttagacacctttcaataagatgatctctagggtctcctccagataaaacattctgatactagcccagccccacctttttggaaacaaggaatttgggaacagacctggaaacatatatatatccgaagtctcctggtttccagagttgtaagctatccatgatgtcaggtcatcccttaattgaagaggacagaggggaaaatctcctaaaagggagagactggagctgcatgatgaaactcaccctgttgaaaatcatcacttcactgtctgtggcaaggtagcgatgaaatcccagctgcacagaaagcagcaacaggatggacccccaaaccaaaccacaacacacatacacacgagtgaagactccctctatattcggtgtcaatctaattcgttaacaaatcatctgatggttattcaactctaacttgaccattcaatggcaatacaatggggaaatttaggcagagatgttcttaaattgaaataaagctaatatttattgtttaccttgtgccaggttccaaatatacaccatctcattttatctccataatgaccctaagaagtaggtgctattattgttctaggcgttttacaaaagacatgcattttaccaactgaaagtgacttacctacaagtctggaatcaacatctagacaatacgacttcaaattcctgaaatactaagactctttcaccattgttacttgatatgagttactccatcacctagtatccagattatagcctattctttaaaaaagcttctccttaaaaattaagccttaaaacaagagcctccttgattttcttaacaccaaaacaattttgaagaaaaggcttttaatatttatcagtcttctctaatatgaccatttgaccagttatttagagcttgacacatggaagaatttagccctttgtcatttttaacaaaccctgtgaaaatatgacaaattactagagaatggtcttgtttagtacaactcaaacaggtagagtaaaaggtatagtaaatatcctacaacttgggttacattaaacatagtgataatgtcatctactcaaaagtgtgataactatataataaaaatgctgggcatttttatgttctatttgggaatcctaaactccaggttgagcaaaaattgaaactaagttgttactttacaaatggcaggtagcacttgatttataagctatgggagggtaaaaatgatacttcaactacaggaaaaattaatttctagaatcttaaaattagttttagtctaaaagactactattttactaaaatgaaaatctaaactctcaatcctctgaacttttctgagaacttcagaaatctatatattcaaaaactaccaattacatgcttctataagacaaatgcatttaaataattgtatttgcttccttctttattcatcattcaatagataattattgagtgcactgttctgggtcccaagggatatagctgtgaacaagaccaagcccctgccttcatgatatttatattacacttggtgaaacactaaacaaatgtagcataatagttgagagctcaagagccaaagagcttaaatgtctgctacaatattcaaaacctatgtgaccttgcataatttacttctgtgttaagtaattataccagagataataattagcatctattgttacatagtaattattatatacaggaaaaggttgttgtaaagattaaataagttaatacatgtaaagaactgagaaaagtgtttgacacacataaaagcccaaataaatgtaagctatgattaggaaaataagtatttaaatatactttaatgtagtgatttacattgtatttacaggaaaacatttttctatgtagataatgactgtgaattaaaaaattcaatctcaacatctgtaaaattacactagaaatatagctttatacttatcacacatggatcaaatgtgaaaaacaggaagattctaaaatcttacctacagagtgaattggacatgtaattcaccctcaggaggcttcaaaatttggagaatgttacaactcaacactgtcttttatagtttcttctctaacaatataagcctattccaagctcaaaactggtgagaaaaatctatgtgattttaatggaaagtcagattatttagtctagcaatgcaaataagcacctgcttcatggctaaaaataaattagggtaaaatctggctttttgcctaaaaggcaaaaaggaattcctttgggaattccttcatatttgttctcttaagagtatgtgactgtgaaatctttagagggatttttgacaaacagatccctgcttgccctgatcagaaatagaagtgttactggcaaatacagaaacagtttatgtgatttgggctcataaatggaatctccgtaagcacaatcatttaggagtattagtttttagtgttttggttgagaaattttaaaaattgagtaaaaatgtgtaaaattaatagtgcaggagtgtttattatgacacagagggaaggatgtataattgaatcattttaattcaattacaaatgaaatattggcatttaaagcatttctcaaaaagtgatggagtaatctattaagggtttcctataggggatatcagtctaatgttatgacacaaaggttagtgttggctattttcccctcttcttgagttgaaacatcctaaagcagcatgaataaaaatctcctcctcaggcttctgtacaagcaaactgaacaaagccccttaaaatcaacatttcaggcttgatagtgtttctgtactataaaagtcaagttgttttgattaaatttactgaaatcaactagttttccaattcaacatttttttctaagctaataaagtttgcaagctcatttcggaggaggggattggagaggagaaatacctagttttgatttatattatcatttcttttatgcttcttttggaccattttaacttttccattttgaaaagtaaaagtatcaaagtttactatattttcttatatgatttttattgtcgtgtaattatttcaaaaattggaagtccataaatagctacgctatggttttgcccttttccccaaagcgtataaaaaaataaaatatatgtcagtcaaatgattattgtcttttagtcaatgggttttttcctttcctttcatatgtaattttagaaattcataatggtttctccctaggtatcaaaataaagatgtgcatgtaaaacatttaaaaatgcacagggcaaaccgagtccagcagcacatcaaaaagcttatccaccacgatcaagttggcttcatccctgggatgcaaggctggttcaacatactcagatcaataaacgtaatccatcatataaacagaaccaaagacaaaaaccacatgattatctcaatagatgcagaaaaggcctttgacaaaattcagcagcccttcatgctaaaaaatctccataagctaggtattgatgggacgtatctcaaaataataagagctatttatgacaaaccgacagccaatatcatactgaattggcaaaaactggaagcattccctatgaaaactggcacaagacagggatgccctctctcaccactcctattcaacataatgttggaagttctggccagggcaatcaggcaggagaaggaaataaagggtattcaattaggaaaagaggaagtcaaattgtctctgtctgcagatgacatgattgtatatttagaaaaccccatcgtctcagcccaaaatctccttaagctgataagcaacttcagcaaagtctcaggatacagaatcaatgcgcaaaactcacaagcattcctatataccaataacagacaaacagagagccaaatcatgagtgaactcccattcacaattgcttcaaagagaataaaatacctaggaatccaacttaaaagggatgtgaaggacctcttcaaggagaactacaaaccactgctcaacgaaataaaagaggacacaaacaaatggaagaacattccatgctcatgggtaggaagaatcaatatcgtgaaaatggccatactgcccaaggtaatttatagattcaatgccatccccatcaagctaccaatgactttcttcacggaactggaaaaaactactttaaagttcatatggaaccaaaaaagagcccgcatcaccaagacaatcctaagccaaaagaacaaagctagaggcatcacgctacctgacttcaaactatactacaaggctacagtaaccaaaacagcatggtactggtaccaaaacagagatatagaccaatggaacagaagagagccctcagaagtaataccacacatctacaaccatctgatctttgacaaacctgacaaaaacaacaaatggggaaaggattccctatttaataaatggtgctaggaaaactggctagccatatgtagctgaaactgaatcccttccttaaaccttatacaaaaattaattcacgatgtattaaagactgaaacgtttgacctaaaaccataaaaaccctagaagaacacctaggcaataccactcaggacataggcatgggcaaggacttcatgactaaaacaccaaaagcaatggcaacaaaagccaaaattgacaaatgggatctaattaaactaaaaagctccggtacagcaaaagaaactaccatcagagtgaacaggcaacctacagaatgggagaaaatttttacaatctacccatctgacaaagggttaatatccagaatctacaaagaacaaatttacaggaaaaaaaatcaaccccatcaaaaagtgggcaaaggatatgaacagatacttctcaaaagaacacatttatgcagccaacagacacatgaaaaaatgctcatcatcactggccatagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccgttgtggaagtcagtgtggcgattcctcaaggatctagaactagaaataccatttgacccagccatcccattactgggtatatacccaaaggactataaatcatgctgctataaagacacatgcacacgtatgtttattgcggcactattcacaatagcaaagacttggaaccaacccaaatgcccatcaatgatagactggattaagaaaatgtggcacatatacaccaccgaatactatgcagccataaaaaatgatgagttcatgtcctttgtagggacatggatgaagctggaaaccatcattctgagcaaactatcgcaaggacagaaaaacaaacaccacatgttctccctcacaggtgggaactgaacaatgagaacacttggacacaggaaggggaatatcacacacaggggcctgttgtggggtggggggaggggggaggaatagcattaggagatatacctaatataaatgacgagttaatgggtgcagcacaccaacatggcacatgtatacatatgtaacaaacctgcacactgtacacaggtaccctagaacttaaagtataatttaaaaaattaaaaaataaatgcacaagaaacagaaacacagcacaaaaacaaacctatcccctgtggacacaccaccactacttgatatgtgtaatgccaattgctcaactagctaatcagttcctactgttggttggaattatttctcttgatattgtggaggaccagttccccccaagaagaattcagttgtcacttaacaatcttttttttttttttttttgagacggagtcttgctccgtcacccaggctggagtgcagtggcctgatctctgctcactgtaatctctgcctccagggttcaagtgattctcctgcctcagcctcccgagtagctgggatcacaggcacgcgccaccacgtccagctaatttttttgtatttttagtagagacagggtttcaccatgttggccaggatggtctcgatctcttgacctcgtgatccgaccgcctcagcctcccaaagtgctgggattacaggcgtgagccactgcacctggcccacttaactatctcttgaaggtaataatcaaaatcacatcacaactgtatcgacatggttttttagcttacttaaaagcagccactctcttaactacagtttcttcatttaaaaatggggaaacaggaaaaccaagaatgattacacaatctgaaagttttgtttcattattttaaagcaggggcctcagcgccatcccataatgagggaattctaattgtctgcataattctaatataggaaggagggagaaaatgaaactttgggcacaaaggcatgtttctgaacctttatccaacaccatttccattgtgggaaccacaaaaaggatgataaattaataaaagaaataggggccaaataaaatcttaaaagagataaaaagaggaagccaaacaaccacaacaaaaattgataatattcagctcaggaagagaataattttcttccctaacacagtgatctctgacttatctctcccagtaactgaagacttaaaaatcatttgcactccgataacatcagattttgcaaactcgcctttgaataaaaggtctcaatgtatatttgcccctatgtttaaattgccaaaccaagatttggttctttgattacagttatatttctataagccattaaagttttaattagcagtgattaaaatcaggtgtatattctggaattcctccaagaaatcagatttctaagttatataataatttctattactaaacaagcctaattttgtaaagcacatatgtgcacattttctaggcacattcaaggtgctcagtgagttttcttccttaaaaaattatctattccctgtaggtgcattctctacactggcaataattaaataacactacttttgattttgaaaatgtttaccatgaaactagtagcagccacttagcctaaaaaagtaaaaaggcctttaaaaaataccaatagaaaacataactgagattttaaatgaatttagtcatactccaagcaaaatcattccagatgatagaacacaacttttatttaacgttagttgttaattctattttccaacattaacattatgggatgctggtactacatgtattttggttgtttcaaagtacaccacattgtaaataagtaataaacaccaataaatcttgctcccagatactatgttgctgttgggacagatctgtatccccgtttattttgtaaggaactatactaaagggaattccatctaggtcttagctagttaagtgactactatgttattagtttatacaccattaccctaacttttattttatatttgatatttcaacattttaaatgtctttatcctaatggatactatttccctactgttacttaataagcaaaatttaaaatattccataaacttgtaatgctcagttcttaaaaggctccttaggattatactatttatatcttttaagcttttatgatattttagacaaattttaatataaggatctataccactctttcatttaacaaaaatttaaagtgtacatttacattctaagcactttgctaggtgctggcaacaccataaaattctgacattttcattatttttacaatgtgaaattgtcaaaattatcaatttttcaaatttattttgaggatacctaaaattatactcatgtagatacctatttctgtagacttgaaactcgtgttcttatagttgcctaacctttactgtcccataagaaagggacaactatatgagctatataaaatttacagaaaatctttatttttatttttttgcctttatccagcaatgattttctacatgaagtcactactagtaaatttcccatcttccttcaacctgtctttacaaagaacatggtaatctagggctagaggcatggaagagggaacaaagaatagttaagaaaatagtaataatagctgccgagtattgtattcttaactaagtgccaggaacttatccattttctcagttacttcataagatacatgttattttcatatcacatgagaaaatgcagttcagaatgattaaatgacttgtttaaatgtatacaactagtgcaaagtagaactgggatttgaatccgggtctgtgtgttccccaagtctatccttagatgctgtactagataaacacaaatgatctcctctttccattgacgtttagtaaaaaagagggaatgagcaagaaatggcctaggagtactctattctctggatgtagatgaaggaagccttttgttttttaatcatctactctttgccaggtattatttgtggtgtcctttccctcaacagcccaatggttgttcccatagtatgggtggtatgatcccatagtggtaagcagaaaagccaggcttcaagcctaagtctccagtcctatgccttatcattgtcttctactaacccaggcagtgacacagtgagggtagcaagtggctacgaaatctccttccaggataggaccaatgcagtgctgcaagatcagcaagcatcactgccctcagtgtttccaactggttattctaactgggcagttttacaataaggttgtccttccatgaaattaattctccttatcagtgacctaagacaagggttggctttctaactgccataaagtcaagagaagctttaaagagaaaaaatgtaaaaatgaaacagattctataataatatgtgattcaaacctacctgcaaaaaccttgggagaagatggtttgactcaatgccaacatatatgtgcagcagttccaggagagatacggattggcaaagtcgcatcacaagtccaatagcataaaaagtgtcaaccattgaatctgtatcccgtgggttaaaaatgcagatataggaagaaaaaactggattataacccaaatttatgcagcactttgaagtcaaatggagattattcacttcctttttcattgtacatgtgaaaaattccttaagtaggctactaaattattaacaatacaatgcaaacaaacaaagcacttcatactgtagtctattttaattgctcctgttccaaaaagaaatcgaaacttgagaaagatttcatggccaaacatacacatagcatttattccccacttataagattataaagcaattcccacataagagtaacctcctagaatctagaccacctcaagtgtaaatagaagtgagcttgttaaggacactatgtgctcacagcttctccactgacaagaaaatgacaaagatgagaaaaaatattatttcggagaaactttatggaaatgacactaataatgccatgatatcaaataacataggtatctaggattttgtttctatacatatttggttagtgcttttctggattttgttaaacactggaacttgggcctctgatcaggacttttggggtttgcattgcagagggttcacatgaaatactgtgcacttggagctgaaatggaagggaaacaaatgttcctctacataggataaatgtgttgctttaagttctaaaatgaaatcctgccatgtttagaaactcgtagggaagattttgctctctttactgcccagtgatgattcacacaataataatttactgagcagtaaggatttctcttctcggcagctccacaagatggacactattatcatcatccccatttcagagatggttcctgaagtacacagtccatgctcttatccactgccctgcacttgctgtaccagagcattatgaattacacagctccgtgaaggaagaaggtagcaggtataacacgttcagggtttcaggtttctgttgagctacttacataatttatacattgattcaaaaattgtactgaaaccacacttagttgttttcagtctgtctcctgaacgaatcggttgtgtttctttaataataagcttctacaattgtaatggcaggataataactgagaaagaaatgcgccgagccgggcacagtggctcacgcctgtaatcccagcactttgggaggctgaggcaggcggatcacctttggtcaggagttcaataccagcctggccaatgtggtgaaaccccgtgtctactgaaaatacaaaaattagccaggcatggtggcgggcacctgtaatcccagctactcagggaactgaggcaggagaatcacttgaacctgggagacagaggttgcagtgaggtgacatcgtaccattgcactccagcctgggcgacaagagggaaactccatctcaaaaaaaaaaaaaaaagaaaaaagaaaagaaaaaaaaagaaagaaaagaaaaagaaatacttgatgactaaggcaacttttctcactggaaaggtgagacagcataagccagtccatggcttgtgttgccaatgacatgtaatatgcctgcactgcctcagcaaacctcaaagggctagaagtgatggctttttaataaaaatataaaagaagttttcccatcacctgtgttttcctgtgcttgaaaactctcaacatttgtagttgaaactcaagctttaggttatatctttggaggtccttaacaaaggcgagactatatctgtagattttcagtaagaaaaagcaacataaaatagcttatgggaccctgcaagtagaataacttccttatgatacacacgtctgaaatgatgagcacagcatgacttttcccagctacattctaaacatttgtttttagctgaagccagcagttgcttagattgtcaagtcactcaacagttgtaaactgtgaggacacttacccacgtgcggatggaacatgaagagaatgttattttgatagtcatttagtcacccaacagtgactttacttttcaggaaactagaggaagtttatgacttaaaccattaatgctgactcctatataagtggttagccctctacaaagtgtgtcatttacatattacttcttaaagggaccaaatagaggcttggggaatataaaatttgtatttcacttactagtagtctccagttacctcaaacctggggaataatacaaacactggaagaatttgattcattcctgatttctctgcataaaatgttatgctgagatttcctcaaaacactagaaatctgctaaggtttggtacagaatggaaaaggaacaatgaaatgataccacctcagtgccatccatctcttttttgaggcaaactgccaactcagggggaagccaaatccctttcccttacttatcccaccttcccccttccccaagaaggttttgcaataaacatggttgctaaaaaatacaaattttagagaaggatattagaaggttgaggtgtgtagaaatttaatataagcaggatgaggtgaaaacaaggattaaaagttaaaaataaaaaaactgtttcggagttttaccttttccaaatgaaaagaatctgactgtcatatttgtaaatatccaagagtggccacagaactggattaagtaatagatgaaaagatacgcattcttcctatacctataaatacaggaaaataccattaaacacttcttttataatcatcctttcatcactgtacacatgccctttaatgtactggccaacctgagaaagcaaaagaaaactgtttcatatcagtcttttatctggttacccccaagtacatatcagattttgaagggagccataacctacactacccgctaaagtaaatacagatgcttcttcacttatgatgaagttacgtcctggtacaccccatcagctgaaaatatcataaactgaaaatatcataagttgaaaatgcatgtaatacaactgatctacagaacatcacagcttagcctagtctaccttaaacttgctcagaacacctacattagcttacagttgggtggaatcatctggcaacacagtgcactgtggagtaccggttgtttaccttcctgatcatgcggccgactgggagctgcggcctgatgccgcggcccagcatcatgaaaggatatcatacctgcacatcgctagcctggggaaagattaaaatccaaaatttgaagtacggtttctaatgaatacatatcattttcacaccatcacaaagtttaaaaaattgtgagtcatggaccatctgtatagtgagtttgcttaaaaccaaatatagtgctttttcaaaatctgctttcatctttgataaagttctaaccttgctgctcaccaaggaataaaagaaaccactgcgaaggtggctttgaatattctttaaaaaaacaaaacaggctgggcgcggtggctcaggcatgtaatcccagcactttgggaggccaaggcgggttggatcacttgaggccagaagttcaagaccagcctggccaacatggcaacttacaaaaaaaaaaaaaaaaaagccggatgtggtaacgtatgcctgtaatcccagctacctagctgctcaggaggctgaggcaggacaatcacttgaacctgggaggtagaggctgcagtgaaccgagacagcgccactgcactccagcctgggcgacagatcaaaactctgttctcaaaaataaataaaaaataaaaaacaaaacaacaacaacaacaaaaaatccatgtgtgcagagtggttgacatgtcactatgtgttccagtagctcagcttgctaagtgcagaacttgagacacagtgttttagttctgaaggggggtagggatgggagtaatccaaatgttgggtaattcagtaattggacacacctgacttttgaacacattatgtgattgaggttagtattaacatcttgccactgcctattaacattttgcaagggtagatagtttccttcatcagatacatatcgaaagcagtttagttgctcataccagaagagggaagtcaagctgggtttaacaatgtgttgtgagttgctggggagatgactaagagaagattgacagatagatggtttgagggagttaggaaaagcactgtttgaaatgttccctgggagttcagaagagtgacgggagtggccctgccagtgtggtcaagatttactcctccttgaagatgtgaaacctcctagaaacaaggaaaataagctgggaggcagaatgatttttatttggggacatcctcccctataaaggcaggaactgctaaagggtttgggaagaggaaatcctccttcagcttgtatcagaattacctggcttgtgggttaaacatatacacccccaggccctaccgctatatgactgaatctgttccccgccggaactaggccctgaaatctatacgtgtgataggtgtttccacggctgttacatctaaaaatcaccccgcaactctgcgtctgagaaagtcaagagaaggctcctggggggagggaagtactggcagagggctcacaagggcaggggtagccatgcagcctgtccttcccattcaactgtaaaatggagaaaataacagagcctgcttcctagggtggtcaagaggggtaagttagcaaatacctgcatgagctccaaggggtgcctgggcacggtagcgctgcgccttgctggcgggcggggggtgccgcccgcccgcccgccgcagaggggagctcccgcctccaggccctccacccgcgccccctcccctcgggattcggccgagcgccctacctgggctgcagccaggcgggcagcgccaagggccccatgggccgccgccgccagggcttccagcgcggtccaggaaggagtaccggggaggaggcaggggcggccccgcggctgggcgcggaagggcggggcctctccacactcagcagtttacaaaaagaaaaagcccgaggtcgtgcgttggggaagagatgaaaacgaagttctcgaagtttctgcagcactgctagagcgcgtcagggcgcaaggctgggaggcggctcgcgttcccggtggggttaccaaactctggttacagcttcctaatctttgtgttgagacccccttgcaagccttctggaaattaatgcatctgggcgatttccggggcctccgaactcgctgaagcccatccccaaacctcccgagatgagtggattccagggtgggctctgctcaatgcccaccggtgagccaggttcagacacgaagcttgtgccgggcgcagtggctaatgcctataatcccagcactttgggaggccgaggcgggaggatcttttgagcccaggagttcgagaccagcctgggcaacatagcgaaaacgcgtctctactaaatgtacaaaaattagtcgggcatggtgacgcgggcctgtggtcccagctactccagaggctgaggtgggaggatcgcttgagcctgggaggtcgaggctgcaatgagccaagatcacgcggctacactccagcctgggtaacagagcgagatcctgtctcaaaaaataaataaaaataaaacgaagtttgtagcacacctccccaacactttttcagctaggggcctgattcctcttctatcaggcctccctgctctctaatctcccttgggttctcactggtgcctgcaaatctttattcacgttgtgttaatttctctagcctatgcccagcactgctacaaccccttcgtgatctctcaggcttatgacatcactgtctccgtacacagatgacccaccctcctgctttgctaataagatccagcccatcttcaagctcctctgcccagaaagggaaacgttaaaacaaaaacagaaacatctaagaaggcacttgcaagtaagtgggacaatggcacctggttttggagttggaagttagcgcccccatttttaccaaaagggaagttgaggcattaaaaaaatgttaagtcacttggcacaggtcacacaattgataaaatggcagtatcagaacttcaaggttggtgggatttcttgtttgtttcccattaggccgtggcttccttttttcatagtccattccattcactatgcctacctctcacctctacatttctctgcaccttctctcataccctgccctcagtcggaggttaaccccaactttgtgtttaccagtcccttctcagactcactgcatcagtagttaaccatcgcctcttcttgcatcgtcatcccctcctttccattggctttcactgcactttagggacatagacaactctctcttagcatataattaaacattgtattctttctgtttctctctcaatggaatcttctaataactccctgcctgccttctctgatcaggtgcttctttcatttcctaccatcttcctgttccataataccttacagtttgactctcctgacactgctccgtccgcgagcatgttaatttttcgccgaatccctatcctgtatcaccttgcaggatgatgccccacggtccttgcttttacagaacatttgatctaaagggtaaactggtggctaacccattatcaatgctatctctgatcaggttaagcagcaagagagaaagtaaagtcccagatggcctgcagtggggcaggagggagaaggtggaaagcctgcccagaagaattgatcctttgtcaccaaacacagcccctgcatccacatcctcattgacaggtctgctgcattttaccagttctgtctgtctgccatttacccctgaagttctacatattctacgtctcttgccttatgtcccttctgtctctctggatgggtcttcttctcctgctgtatttcctcaaaagtctgcccttagtcaccatccatttgtcaccatgttatccctcagcatagacaaccacacatggctttatctccatgtggacaacttttgactattattttcagccctttcttcttttatgaatactatctctggcctttgagcagcttttggatatttcctcatgaaagtcctattgtttggactatctttggaacgtcttccaattcaacctatttaaaataagcatactatctctcttcctaaatcattatttcccacagaaagaccaccatttttctagccacttgattttaaattggggagtcatcattaagcaccccatccaatcaaattcgattgatcccatcctttccagatctcctactaatcagtagtgttctttgtccattccttattttccagtacctgggtgaggagtaattggcctccctcacatccattctttacatcataactcagttgactttctggagcgtcttgggttatatctttctgctgcacaaaaagaggccctttttagttgccaaaaaagaacaagccaatcagtcgaaaaataaaaaatcctttcaaatcaagcagttagctgattctacgttatttcccaaggaaagagtacaaaaagagcttaggagagaacattttgtatgaaaagtgaaattctccctttcccctggtcagttcccagtcctgcccacgtcctgccagcattatcaagatggcctcccccagcctccctgcctccaatctctttcctccttctacccagactgccatagattatttaaggatggcaaaaatatttcttaaaacacagttctgatgtagccattctcctggtctaaatcttttgctgactccccgttgcctgctacagtatatctcttcttgcccctaaacctgtcacatgctgacatctcctaccatcctatccccttaccaaaaatcacagcaacctgctgttccatgaccacaccaggcattctctggccaatgtgcctctgtgaaaaatttcccgtctactttttctattctacctcctccccttatcacagcccagtacttacctgtcaaaattctattcattctttaaaagccttcccaaagatcccctctgggagtcacataggctaacgtatgtctatgttggtatttatcttagggtattgttgttgtcaaggtacttgactatttaactagattatagattctcagaggcttctctctcactaacagtgagaatttgacaacttttaacctttaaaaatgaagtttcttttgccaaaagcacacagttattagaaagatcaaataataaaatttatagatgaaaatggataaaagcccctagtacagtgcttggcatagtaagtatccataaatatgttggatgaatgaattaaatctagtatgagttttctattcccaaaattttaacccaaaacaaaacattcagtgatagttacattactgaagtatgtatattcaactttcagttatccactggtacagaagaagtcagagtccaagataacaactgaattaatatattctaatctttagaagaaattttaaaattattcgaacatgtcaattttgttttccttgggcaaatgcttcaatttgttttcatcccaaagagcaccatctgggaggctaaaaccttgaaatatatttcatggcagtaacagactggctacaaaataaattcttttttattttcagcaccttgagttttcagaggtcactcctctccctcaaagaaaacacagaataaaactctttgtgaccttgggttaggtagagatttcttaggtatttcatctaagaagccctcttagatagctaagcaagcatttcttagctacttctggccttcaaaagacactttcaagtgagtgaaaagaagctatatagtagaagaaaatatttaaaaatcgcataactaataaagaacttgtttgcaaatatatacagaactctcaaaactcaataattggaagacaataaacccccccaaaataggcaaaagatttgaaaacacacataaccaagtaagagacaaagaaagaacataaaagtatggtcaaaataattagtaattatggaaatgaaaataaaaccacaatgagatatcgctacacactgataaagatggctaagatgaaaaagagttaaccaccacaagtgttagtgaagatgtgccacaatggggattctcataagcagctttatttttaatagccaaaaactgaaaacaacccaaatttccataaacagatgaatggataaataaattatggcataactgtacaatgaaatccaactcagcagtaaaaagaagtgaactactgatacaagcaataacatggatgaaattcaaaataatcaaactgaatgtcagaagccagaaaaaaaaagaatagatactgtatgattctacttatttaaggctctagaaagtggaaactaatcatcactgatagaaggaaaataagtggctgtctgaggatagatagtgaagaggaatgaaaaaagggagggattgcaaaggagcatgagaggtggaaatgttaattgttttgcttgtggtgaggtttttcaggcatgtatctatcttaaaacttatcagtttaaattgattcagtttattgcagtttagtatatgttagttacacctcaatagagctgttaatacactaacacactaatatttaacacactaatatttataaagagaaatgtagggttttctgttttgaataacttttattattgcttatgatataacatcctgtgattttcaagggaaaagtaaacaatacaaaacaagatttttcaataaaaagaaactcagtatgctccagggcagactctttgatttattgcccttctccccaaggcaccttagcgtatggcatttacacaatctgcagttggtgaatactgggtcgcagacctgtacatataggcccctgggttgtcttttagttcatgatagcttcttgaggggcttacttgcactggtgtctgtacactaggtgtatcctcattcaatatgttgatagtaacctaggcccacttaataccaattaaagaccccctatcacctcctgtcttctctccttcccttgacagtcttcctttccatccccaggcctccattcgttcttcattctctctgccatctcctcatccccctggcagttcattcggaaacttctgtgcaggcactgccctgtctctcccacattgtgccctgaatttggtgctaccctaagagctcacaggtttccctgcatctgcctgagaaaggacactaaacctatggcatgtgattcttcctcttggcttaggatatttctattaccacatctctgttcttgtagcagggctggggtagatgaggctagcagggcacctagggtacagactttgaggaggagctccccttcagccttgcaatactgagagggggtgcctgcttaaattttgcaacttaggcatctcctattctcactaagtccctgccctaatttgtggttttggtttaggcctggggtagggagctggggagagggaataggggctttgctatgtagatctttccattctatatgctttttaaaaattctacattccattttgccatgcttccttttttagaatatctttcctcctatcctagaaaccttgctactaattccctaggcaggaatgtctccccgtattttcatatcctaggtttttgttccctgtggcttattgtaaaactcaatccacagctctctaagctttgctatcctaaaaagagtctttgggggaactgagaaattccttttattcaaagccagtgcttcactggggactgcaagagcccactttgataggtaaaagcccagcatgaaaccatttcattcctttacattcttcctaccacaagccaaatttcctgaggcaaaaaggatgattctggcaggctaggaaggtcatgcaaagagatgcaaaaagaaaatcatattacggtcatcccttggtatccatgggggattggttccaggacaggctacctgccccactccaagataccacagtccagaattctcaagcccgttatataagaggacataattgcatataacctacacacattctcccatatgctttcaatctagattacttgtaatatttaataccatgtacacattatataaatagttgtgatatattttttaatttttttcccaagtattttccatctgcagttacagaactctcagatatggagagccaactgtaatatgtttcaaaactgttattcctgctatatatagttaaggttttatttaaattcacaattttcatttctatatattcttgttcaacatcattgcctacgattactgaaaatgacttttcttaggttaactcaccttataaactgcttagaagaatcactcagagaaaagcaagttatatgctaattttttagagtttagttttttggtgatgggaacattatttgggttgcagatataagtagtttcaaaagaagataacttttatagtatctcagataaaatcatttgtgttatattctggtcattattaaaggcagtgttgctttttggtagtctaaggtaagaggttttctaatgagcctgtaagaatttaagagtttgtaattgtatgatatacacacagtcaagaagcaaaacggcaacttttttttttttttttctagtagagactgagtcttgctatgttgcttaggctggtcttgaactcctgggctcaagtgatcctcccacctcagcctcctgagtaactgggattacaggcatgagtcactgtgactggcccctgcaacatcttttgtaatctatttttgaataaggaaagttaaaaaacaaagaggtaaaattaaaagacatgatctaagcatttaaaattaatttgtctaaaagttattgaaagccaggcattgttgcttatgccggtaatcccagcaactgtggaggctgaggtgggaggattgcttgagtcctggagttcaagaccagcctctttaaaaagaaaagttattgactcactggatgtttaaatagattaacacagttcatattatatacttatataaacttaacaatgctaggaaatgcttgtccccagaaaaatatgaccagaaacctttcttccttgaataatgggtttctgggatcaagaaaaaagatttactctccagattcttttattctgtattgcctcctaaaggttggctattctctcaattcagagggattagataagaagatcataaagatttttatgatctggttctaatactctaaaatgccatgattaattcaatttctcaaatatatgctttctataaaagctgttcctagaaaagccatcagctgtaaatgttgttaatgtttgtacttcttcattcatgctttggttttatattttcactctgctgtttgtgtatactttccacagaattgtttatcaaaaatattgtgtaagacctgggcctttattggccctaattgtttatcaaaattattgtgtaacacctgggcccttattatctcctttgggagataataaatataaaggcaaaaagacctggcctccatactcaagaagattacagtttaataatttttattaaattattctcagagacagaaataaacagttacaggaagcaaggaattttcactcaggagacctattggagagacctgggtttgagtgtaggtttcgcttctctgtgatgttggaaaagtattaaagcctctcttgagccccagctcctttatttttaaagtgaaagtaatgctgttacagaccctattgtacttcctgtgtgaggatcaactgaggtaactgtcacagttcaaatgatatggaggccaaggtcctggcaagcccagcaaacaacctgcctgaagcaagtttgaaggtagagccctggatgctgcctgtcaaattatgtggagccccatagaagacagaaaagtgggggtcaagccatggtagacaaaggaattatcatcacaatgaagttcaagagcttagacctcaatacattttctgtattgaaacaaggagtcatattatagaagaggaggtaatgagcagattggtgggggcgcgacaaagggaagagacgaggtggattcagaaatggagggttctgtaaggaatcaaaaagtcaaggctgaacccagataggaatatctgggctggttttctagataaggattggctagacaaaagcaggaagaggaggcagagagatgtcaaaggcaaagtatgcttgtatttgcctattaggcagatagaaaactgatttcgctgtctctggctaggtgtgttgaaggtaggtagagactgggtctctgtagggtgtatcagaggatggctagatggctaaatagcatctctacacattagataccagggtcaagggaagagaaagaaaacttcgcctccttaacattagtagtgggctacttaagcttggcctactcagtgcaggttaaccttgctttgagatttagtcggttaatttttaaggtttattagcttaatgtaactacatttaaatgtccactcgtcaagtttgtaatggtttcttatctcctcattaggaataatctttactgcatataaaacttttaagacctcggtgcagatggttacttgttttatattgctggtatgaagttctattctatatagctggagattgctttagtggtgcctactgtattgtctgagagaccaaatccatagatgtgccagcctcagcccctaggaagcagcaggcatcctcttagaccagcctgatgagcagcgaaggcattgagtagaggaccagtagaatttagtcaaggaagaacagaaaagaactgcaaaataggtgcccaaatcagagagtagccaggtaaggagccaccaggagacagagatttagaagaaaatgggactagttctgttgaatcctaattgatgatcttgttgactccgacttgcctttatgggatgggataatctccttccacatttccaaaatgctctagatatgagctttaataaaaaaaatttttttttggtaaaacctttctctataaaagccataaccagttaaaaagaaaatagaattataaattccattcacaatactaacaaaactataagatccctagaaataaagaagatacagattacttaagaaggaagatttttaaaaaatcatattataggatattaaaaaggtgaaacagaaggaaaaatatatcatgttctcaaatggaatccttaatattctccaaatttaaaatttcccaaattgacctataaatcgaaggcaattccaatgagagtcataaagaggctttaaaattgaattaaaaaggccgagcacggtggctcacgcctgtaatcccagcactttgggaggctgaggcgggtggatcacaaggtcaggagatcgagaccatcctggctaatacggtgaaaccccgtctctactaaaactacaaaaaattaaccgggcatggtgacgagattccatctcaaaaaaaaaattgaattaaataatcttaaagttcatacagcatgtctaagaatagctaagaaattaataaaaaagaggaatagtgagaatgacttgaattataggataatagatcgtaagaaaaacatttaaaaaaattacaagacaatgtatcatagcctcatgacattgatatagaaacaaacaaattgaacagaaaataaacaagatcccaataatgaatttttttttatatatggaaacttaatgtttgacaaagatgaaacgtcaattcaatgagaaactattatgatctaagaaatggcttttacatgtggttaatccatctggaggaaagtaaatttggaaaattaccacacaccacataaaagtaaagaattacatgtaaagacaaaggcaataaaacattttataaaatttagatgattatctggacaacctgtgtgttagaaagagctgttcaaccaagataggattatagattttttaatgcaaaagaataggcaaagaagataaataggcaattcacagaaaagataatacaaatttgtgggttttttttgaaacagagtctcgctctgttgcccaggctggagtgcagtggcacgatctcagctcactgcaacctctgcctcctgggttcaaatgattctcctgcctcatccttccaagtagctggaattacaggcacccaccatcacacctggctaatttttgtatttttagtagagatggggtttcaccatgtttgccaggctggtctcaaactcctgacctcaggtgatctgctcaccttggcttcccaaaatgctgggataataggcatgagccaccgtgcccagccgagaatccaaatttatgtgaaatatatggaaagatgctcaactctttaatagtcaaggaaataaacactgaagtaacaatagcatattttacatccatcaagttggcaaaaaatttaagaagctgtaacactttctgctaatagggataaaatgagttagcaccaatccagcgcatttggtgaaatttggtgaaaaaacgagatatgaccaggtagaatatatgcatcataccgttccatcccatttttgtaaaacagtgatttacacaccgcaagaaatacacacaaacagttgcaagatggtcattagtcacaaaataaatatcacagtttcaaatactattgacagtaggccatcttcagggaataagttggcccatttaatgttttttcctttttaaatttagcatcatttccgtatagtaaaatgcaaaaatcttgaatataaaattcaatgagttttgaaaaaaagcgtatacccaagataactcactcctcatgaatatatagaacatttccgttgccccagaaagttcttcatgtcttctcagttgactggttcctgtcacatgtcccttccttgtgacttatttctatcactacagatttgttttgtctgttctgaaacctataagtgggctcattatgtactctttcatatttggcttttgttgagcataatgttttcgagattcctccaagctgctgcatgtatcagtggttcatcttcttggtgagtagtattccattttatgaatataacacaatttgtttctccattctcttgatagacagttggattgttctcaatttgaaaatattatgaagaaagctagtaacatccttgtacaagtctacttgtagaaatttgttttcacttctcttaggtaaatatttaggaatggaattgttgaattatagggtaaatatatatatatatatatttaataagaaactgccaaatagttttcctgagtaattgtatcacttacatacccactaatgatgaatgagagttccacatccttggtaatatatcagtgtttttaattttagccattccataggtatataatagtatatcattgcaattttaatttcatttccctgatgaagtatgttaagtgtggtttcatgtgcttatttaaccatttatatatcttcttttgtgcagtgtctcttcaagtgttttctccattttatagggttgtatgtcttattattgaagtataagaattcgtataatatgaatacaaggcctttgtcagatgtatgtattgtgcatatattataatatacaactattcattttttaactcagattctgacagattcattttcttaatggtattttttgatgaaaagaagttttaattttgataaagtttgatttttctttatgattagcattttctgtgtcatctctaagaaatatttacctaccctaagattggcaaaaatatttgcctgttttttcttttagaggacaattatttggatattgaccttgtattctgctaagattctactagttctagtacttaattttgttaaattccttagaatgaggttatgccatctgtgaagaaagtgagttttatttctttcttccaggtctttatgccttttatttcttttacatgcttattactctggatacaatccacaataaaatgttgaatagaagtagtaagagtggacatccttgctttatttctgttcttagggagaaatcattaagtctttttcttcattaagtatgaagttagcagttgaagccttgtagatattctgttagattaaggagattttcttctattcttagtttgctgagagttttttttgtttttaatcaggaataggtatggaatttcatcaaaggacttttctgcatctattgagattatatttgttaatgtgatgaagcaagcttgcattactggaccgaacctcacacttagtcaagatgtgtcatcgttttcatgtgttgatagatttgtttgccagtatattaggcttgaagtctactttgtttgacactaatagttactctaaagttttcttatgacaagtgactgcatgttatatctggtcctattcctttacttttagcatttttctaacattttgcgtgtgtctcttataaacagcacacagctgggttttatttttttttaatctagttgccaatctctgccttttaattatttagtttacacttaaggcaatcatcgcgatgattgggttaatatctaccattttgctatttattttctatttacctgtttaatttttttttcctccttgcctgacatttttggaattatcaagtacttttgggaatcccattttgtttcttctattggctttttagctacaattttgattcttttaatgatctctctaggaattatcagatgtatcataatcataacatacactgaatattatagcacatcacattcgctgtattttaagaaacttgcaacaaaattccatttgttcactttcctaatttctgctatttctgtattctgtcatacattttgcttctacatataaaacaataaattttagttttgtttgtttgtttgtttgtgacggagtctcgctctgtcacccaggctggagtgcagtggcgcgatctcggctcactgcaagctccgcctcccgggttcacgccattctcctgcctcatcctcccgagtagctgggactacaggcgcccgacacaacgcccggctaattttttgtatttttttagtagagacggtgtttcaccgtattagccaggatggtctcgatctcctgaccttgtgatccgcccgcctcggcctcccaaagtgctgggattacaggcgtgagccaacgcgcctggcctagtttttgttttagaaagtcaattgccttttatataaattttaaaatgaggaggaaatctttacccacttgtgtacaatttctgaaactcttcattctgtcacatagattctcttttcgtctcataccatttctggattttgttatacttttaaaaatattggattttgtgctagcaggcagttgatttactgtcaggcagcttgatcctgcccaagcttgtttttgcttagggcagatgtagagcggccattagccttgcgttagagtagcccttctaaaacatgacctgtctcaggtctcaactaaataagcagggtcttcagtaaagtctttcttttttggctgattggaactgccacacctttctctgtggaaaagcctctggagtctctgtgtggctctcagcttctagtagctgctgtcagccaggcattgcagatccctgccttgtgattgcataggttagcatttggcaaaagacactagaggacacctatgaagacatctggagatccatcactgcatggctctttctaatttctaatagcacacttctagcctcttcagccgccttgaactccaatatttgttttctctctccagcaggagtgctgctttccaataggaattcacttccctgtgccatggcttggaaacttcccctaggcagaaagctggtgttatccttctctcagggaccatagccgtggactgtttcttgtccagtgcctgaaagatttatagagttgatttattgtcaagttctatcatcatttacagtgcgataccaattattccatccaatccagaattgttatacaggtgaactctctatataactgacacttaaacttcaatcacaggaatctttaaaaaagtaaagatttcttatagaagttgtaaaatatagtatacacttttctgattttcaaaatgaaacactaatactatttactcctttatcaagaacttagtcgcagttataaataaaccttattctgcatggatcccctcaagagctcttgaaatgggaacttgatatttatgaatgttgctatagtttgtgtaggacccacatccatgtgagtgttgttccctatctctcttcatttcccctactttttcccaccatttgacctttggaaaactaaattattcctgtcttagtttatgcatagcataaaaataaatctataagttgtaattatttggtgcattccaatccttaatatacctgatttttgtcttatctctttagaatcatctctattgttacagattatgaatcattgaatgtttccattttattttctgtattatagtggatggtatacttctgtccgttttcaaaggagatttagatcattttcaactctttaacttacttttccactcaattcaaacccacattgtcacacacaaattttgtgccaagtgaggtgctaagtgctggcatttcgaggatggagaggagtgttgtgactccctacaaaatgaaaatcatgaaaatggcttccttggtgtgtttcttacatgaaaacttagtactgatttgctgttctgttgatattcatatcatagccctttcaaggccccacagaacttagggctgcttatgaatgatatcaggttggatattttaccagatatcaacatttcttccttttaatttcttttactgttattttttcctccaatacaattaatttgttttaacttttgtagaccttgtgatccagtgcaggtatgacgaaatgaacctgagcctaattttttttattgcttcaattcttatgtaaaaataattagactgctttgcaattgtaatgcccttcatgtaaaggtttgttcatatttaacagagactaggctgtgtatgagtggaagtttggaaattttgctgtaattctggcttgggattgggcacaaagaaaatcatttactcatgtgaagccaatttgcctcatctgtaaaatgactttgatagaaactgatcaatataagagcaaatgatggtaataattataatgccaactatagctaaatatattgagggttgactcttgctagtcactattctgaacactttatgtgggttaactaatttgctcctccaacaaagctgcaatgggagtactgtttattatttccattttacagatgaggaaactggaacacagatgatctgagttacccagagttagcactgctagcaagtggtaaagctagtattttaactcaggcctactcaaatgattgaacagtgctttcacatatgtactgttttacaaatgctgaattaaaatttgcttcagaactctagaaggcagtattaactaaacagaaggtttggcttgcatttacactaatctaaaattccagtctgcgtcccacaggatgttcccccctgcaacttaattacatctgaagctattcagatacccatccatcaccatttcattttccatggcagctgtcagccataggggaagatcttcatgttaaagcaattgaatctatcatcctcagggcaggttaagatgcaactaaaggctctttcccttatctgtgccttctgctccagccattaccttatctctctctttccatttacagccaagcatggcatgcttttcagacctcatcttcctggcttttctgccagttgttaaccacttcctgctgttgagccctcagtgctccgctgctgtccactaccatatctccttctccttcttgggtcctcattttcatttcaggctttccatatttcataaactatactgtttgtatgtgtgcctccttatcacccttccagctttccgagtacaggaacctttgtatcctcacccccacccagcacaatacaaggtgaggagcagctactcatgaactggggtttaatgttgtttgaaacagctgctattgagaatactgccaggtaaccccataacaactccttggggatggtaaagaaccatactccaggaaaattgtggatattactatcaaagtttttctccacacttgggaagctatgcatgtttgaagacccagggaaagaatgctgtggaaaataaatgactaaatttgcttacgaaataaagacaggatattatcgtgagagggggtaagggaaggatgccaaggaatacacaggagagggatgtgtcctcaccttcttggctctgctgttcctgaactaaggttccttctctctcagagaaggaatgtcttcaagagtttctttgaacatcagaaattttctaataggaaaattgttagctcacctagaagcatactgtgttgaagatctttggtgattaggcatttagcttgtttggctttgatttgagagatacctttaagatgtttgtgatttcatcaaggtacaaacttgaattgtacacacaggctgggaggctgagtgcagggctgtgtaagcctagcttcccaagctcagtgtacaggcccctaaatgggcttggtagtgctggatggacctgccctttatgtgtatatgggaaaatatacacaacaccagtgttggggtgttgcagaagatcttgaggatgcaatcctcacaggtgttagagtatagtttagaagcagataacatcgatgggtgatgaactgaagagaaaaatctttaagatgataactaagccataatgatttattgtcaaaaatgttaaagtgttttcaaaaacaatatgaatataatgatcaagttagagttagtgcctaagagacattgagtgaggtgctcattcatccttttaagccctagttttcttgtctgtgaaatatttgttctaacttcacagcattgtggtggggaagaagtcatactttgtttggtgtgttacagttcttccaggaaacaataggacatgtagagaaatatatgggaaggggcttattaggggaaattctcacttgactatggaggctgagaagtctggtgataggctgtctgcaggctggagaaccagggaagccgggggtgtggttcatccaagtctgaacctcagaaccaggcaagtcaatgatgcaactgtcagtccgaggccagagagctacggggctgggaggctgctggtgtgactcccagaattcaaaagctggagaacctggacttccgacatccaagaataggagaaaaaaggtgtcccagctctggaagagagaacaagaatttgcccttcctccacctttttattccatctgggcccccagctgattggatggtgcctgtctatgctgaaggcagatctttcccactgtctgcagactcacacacgagtctcgtctgaaaaaaccctcacagacacacctggggcagcccaatcattctagtcaaatgccaaaccatctgctttctctttcagcagaagagctcactgaagcattgagggtgattaatgcaatgattcagagtaaataatgctttaccagctatctgggtatcccttaattaagtcgacaccccaaatcacccatcactgtgtgtgtgtgtgtgtgtgtgtgtgtgtgtgtgtgtgtgtggtgttagcatggtgcttggctcattgttgctaaaatttaataaattattgattaaactatataatttgcaaggatggcacactcactttggtgctaaaatatttttgctactaatcaatagaaattgacatgttaactttttcttaatgaaacaggtatcacctcatcctcatagtagttatggtggaacaaaattgtccttcttaaaccagtaacttgcttcttaaataaatatgttgcagttgattaggctttgttagggtttaaaatatttaagtggcaaacaatgcaataatagtttcttgaattatctttaaatgtatttttttgtaggagatttaatttaaatgtattttggtaggagatttcacattttatttaacattttcccaagtacttttatatgctgtatctcacttgatcttcctaatgagtaggaaaggtaaatattattagtctagtttcagacttaaggaaactggagcttcagagggattgactgtctagtcacatgacatagagctgtccacacctgatacatactgcaagccagattttctgacccaagtcatgtactcattccttctcacactgcctctccttgttgtagttatcaatgactggattcaaaactaagaaacttaagtattaggttggtgcaaaagtaactgcagtttggaccatgaattttaaatcgttataactaggctcaaacacatctttatttatcaaaataggaaccattacaatcaacacatttttgccaatgaaaaataagtttattcatgtagcttaaaaatccatgcttcaggatttgacaaactcttggaaagcattttctgcatcctgttgcttgtggaagcattttgcctacaaaaagttgttgagatgcttgaagaagtggtagtcggttggcaagaggtcaggtgaatatggtggatgaggcaaaacttcttagtccaattcactcaacttttgaagcgttggttgtgggacatgcagtcacgtgttgtcgtgaagaattgggccctttctgtagaccaatgcgggctgcaggcattgcagtttttggtgcgtctcattgatttgctgagtatacttctcagatgtaatgttttcactgggattcagaaagctgtagtggatcagacgggcagcagaccaccaaacagcgaccgttttttggtgcaagtttggctttgggaagtgctttgaagcttcttctgggtcaaccactgatctggtcattgccagttgtcatatacaacccacttttcatcgcatgtcacaatccagtggagaaatggtttgttgttgttgcatagaataagaaaacgacacttcaaaatgatgatttttaaaaatttttggtcagctcatgaggcacccacttattgaactttgtcacctttccagtttgcttcagatggcaaacaactgtagaatggctgacattgagttcttcggcaacttcttgtgtagttgtaagaggatcagcttcgatgagtactctcaatttgttgtcaacttccgatgactggccactacgctcctcaccttcaaggttctcctctcttttgcaaaacttcttgaaccaccactgcactacattcattagcagttcctgggccaaatgcattgtcaatgttgcaaacaccgctgctttaccacccattttgtacttgaataagaaaattgcttgaacttgttttttgtccaacatcactttcatagtctaaaataaacataaaataaacaatgagtaataagtcattagcaaaaaacctaaagtgacaaatgcccattaaaatgatgtgtaacataaccacattcatttaagaatgtattcctatatcaaatggcaaatgccaacaatgcagaaaccgcaattacttttgcactcacctaatatatttaagcacatgcccccgaattttgatgagctctcttagttataagggaaaagcttcttaaatactgtgcattctttgctatgcaatatttaactatacatttctgagtattgctatggatacattttttctgtgtgaaaattaatttctagggtatgtatcctcagttaccataggtagaatttgaaaatactttctgaaacatttaaaaaatatcaaattattgtcacttttactactgtattttattatagcctaattcttaaatcttataaattacatatggcatatattttttattaaacttactgacaaataaacaaaagcttttgaagattttgaaaaatccatgagatgtttctgaaggcctctagcaaagaaaacatttgaaaggtggaagcactaaaagatcacacataaaaaaaaaattgattgctgccaggagtaccatctctcagtaggtgggcttttcttagaaactctctttttctcttcattcaaaacaaggtcacgaagatgtgtcttcttttcaatgtagtgagacagatcagcaaattaaaaaaagaaaacctgactgtgggaatatggaagactatgggactgtgggagaatgtcatgatccatgcgagcccactgctggtcctgaggtgggttgggtcagtatgtggttactgagcagtatgttgggtcagtatgtgatcaccgagctgtgtgactatatttgtttcctagggagctgggtggcttaaaacaacagaacttctttgtcttccagttccagaggccagaagtcccaaattaaggtgttggcagagccacggtctctctgaagactttagcaggtgatccttccttgcttcttcctagcttctagtggctcatggcagcccttggtgtcacttcatttatacatgcttcattcccatttctgcctctgtcttcacatggcattctcttctgtgtgtctgcatccagatttcccttttcttataagaaccccagtcattgcattagggtatatcctaatccagcatggcttcattttaacttgataatatttgcaaataccttttttctaaataaggtacccagggttaggactttaacatatcttttttggggatagaattcaatccacaacattgacagagcagaaagaaaaatgtggccagttctattccccatgctgccaagtgaccataggtgaaccccctggaatcctggatactcaaaatgtgttctccagaccagcactgtagtatcaaacattacctgagccttaattcaatatacagtagttcaagccccattccaggtgtactgaatcagaacctgtatgttaacaagatccccaggtgatttgtatccacatcaaagtgggctgagcactgcctaagagcagtggttctcaaagtgtgggtttcacctgtgataaaagaaaaacttcagctgaattaaatttaaaggagtttaattgagcaatgaactattcgtgaatcgggcagcccccagaatcacagcagattcgcggagactccagtgcagccatgtggtggaagaagacttacagacaaaaaaaagggaattgacatacagaaattggcagtgaggtacagaaatagctggattggttacagggtggtgtttgccttatttgaacacagtttgaacacttagcagtctatgagtggttgaagtatggccactgggattggccaggactgttattgttataggcgcaatgaaaaactttttcatttagagcaggggttttcatttctggcttcacagaactctgcatgtctaggcctcacccctggaaattctggagatctagatcttttggaaactctacagtgggttctattgcatagccatagtgggacccctttgccttagggagaaataattgatggttaaattaacttactcctaagctaggttttcaatgttgtctgactattaagataggttacagttcatccacaagaacccaaatatacaagtccttctcaggccatatttagtttcctttaacacctgtgagcttgttagaaatgcaaagtcagggctgggagcaatggctcatacctataatctcagcactctggggggtccgaggtgagcagatcacctgaggccaggagtttaagaccagcctggccaagatggcgaaacccgtctctactaaaaattcaaaaaatagccaggcatggtagcacgcgcctgtaatcccagctacttgggagactgaggcagcagaatcacttgaacccaggaggtggaggttgcagtgagctgagattgtgccactgcactccagccctggtccctgatgacagagtgagactctgtctcaaaaaaaaaaaaaaaaaaaaaaaaaaaaaaaaaaaaaagcaaagtcatgggttctatcccattctggtaacccagaatctctgggcataggctccaggaaactggctcagcaaactccccaggtagttcttacacacttaagttttttgaaccaccgatagggtttgaatttgtgtccctgcccaaatctcatgtggaattggaggaggggcctggtagttggtgactggatcatgggggctgatttcccccttgctcttctcatcatagtgagtgagttctcatgtgatctgatagtttaaaagtgtgtaacttctcctttctctctctctttctcctgccaccacgtgaagaagatccttgcttcctcttcaccttctgccttgattctaaggttcctgaggcctcccagtcatgcttcctgttaagcctgtggaactgtgagtcaattaaacttcttttctttgtaaattgcccagactcaggtagctatttacagcggtatgaaaatggactaatacaaccactgatgcaaaaaaaaactccagaactatcacagaaaggcaggtggcaaagagaaacacctgcccaagcataggtatggaaggcatcacacataaggaaatatgaggaaaagtcaatccagcacagggtaagtgggatgccattgctcaagtccagaaaattcatgtcatgatatttgggcacagaggcaatggaggtcagagaatacctcagatgatggggaaacagttcatggatgtaaaaaaaggacgccaagtatgggacccacatttgccatttgagaagaagtttttcatttagggaacggggtttcatttctagcttcacagaactctgcatgtctgggcctcacctctggaaattctggagacatttcggaaactccatagtgggctctaatgcgtagccatagtggaacccctttaccttagggagaaagaattgatgattaaattaagccatagacttttgatgcagaatataaattgctctatagtagactataagtgtccatgcaatgtgtctatagtagctgtttagtaagcctcagagagcaactgtagtgtatttttggtttgtttgttttttggggttctattaattctttatttcccaaagaccaaattaaagaatcttttccggaggcccagaggccctaaaaacatggtagatccactcaatcatcctgtcgtaatttgctgatggtatagactatcctttactgaggcaggtggatcaatagtcatacaacagggatatgggcttgctgagcatggccatccatttgttatgtgtatgctgtatggtatatgcacctgatagtgataacttaagcacaccttgagaatgccctgtatggcagatgcacctgaatatgtgtttggagttctgagctaaggaatccaggaatggccaatctgaaaattcattcctcgtctatgaggaacatctaaatccctggcctgtcttgtggatcatgtttaatacagggcagcaaggccatttgttttgggttaaatgaaggttgccaggtagaggttgttgtgggaagagtgctaagagaaaatgctatatgaactgcatgtttttctctggccagcctgccaccactgggccatccctttatgtaagttgcctgctaataaaactctatgtctctgggaacagaaaaacaaatagacaaacaaacaaacaaacaaacaaacaaaaaccaacccccaaacccctatgtcttgttttctggctctggtttctcctttggcgtcataaacctactcccatccctactgatcttaataggggtctggcatgacatatgtatgtgtatgtatacatatacataactgaacaaagtagacaaaaatgcctgtctttatgaagcttatgttctattgggagaagacaggcagtaaacaaataagtagaatttatttttttatcagatggaaataaagcagacacacaggatgaacagtgatagggtgtagagggttacaattatataaagtgatcagggattgcctgaagggaacaacccattctagtctaagtaatttgagacatgctgtattatggacattgtgttttacatcaagaaggaaccaagacagattcaagaagttgccttctcctatgtcctccctctcacccaagaatccttgggaatccagaaccggggtgtccagtgtgatagccactagtccatgtgctacttaaatttaaattaataaaattaaataaaacttcaaaatcaatttctcagtcatactacctacacttcaagtgcttaaaagctacagggctaatgtctactatattggacagcaaagagaacctttccattattgcagaaactcctgttggttagagctgctcttgaatgaagtgggacagtatcttagacaaggaaaatggcttaacaatgggcacaatgacctaggttcagctgcggattataggagttcccttctttaaggaaatacatgtgactaagatttaatgatacataacatagaagataagtggcaacattttagaaatattttttttctaaaaggagttattgtagagtttaaaaaataatgatgttaatcagtacatttaaattcaacctcactcagagaaatgtacacgcctggttgtaaattgtaaataattggtttacaatttactaattgttatttacgaaccaattgtaaataattggtttcttgtgcaaaggaaggtatcttgttagctaagcaatcattttgtttctcattcagtcactcaccaaagaagagaatcttttcgctctgtttttaaaactgaagttagttagttgtcaattccacctagaaacatgaaaataaaaacaaaaacacagaataaattgatactgagaatgtagtcccaagcttcacagaggcttgaagacaacactaaatgaacacacgttgataatttatgatttattgttagtggacttaggtgggggattgaagtggggaggagataacaggaagtctaagaagagggagtggcctcttctagggtatctctacttagtgtgagagagaaggctggtaggagtgcatctcaagaatttctgcctcatctttctccctgctttgtcctcccaattttatgttcccccaaaattcatatcttaaaatcttaacccccaaagtgatagtattaggaggtggggcctcttgggaggtgattaagtcatgagggtggagccttgatgaatgggattagtgcccttatgaaaaagaccaaagggagtttgtttgctcttttcaccacataaggaggtagtgaaaagacagctgtctatgagtcagaaagccagccctcaccagacacggaatctgctggcaccttcctcttggactttccagcccttcagaactgtgagaaatttctgttgtttataagctaccccattaatgataatttgttatagcagtgcaaactgactaagacactccctttccttctgttttccatatctgccatcacctttgtcccatgcctttctgtgttctcattcttctaggaaaccacataaaacatccagaatttcaaatgggcatgctgaggattgggatggttccaggtggaacacttgttgctgtttccctagctcaagtgtaggatttattgagaacaggaactgcgaagtttttaatcatagccataatctttatcaggctgatagtcctataatctgtctgcatttaaaaggtagcctttccccgcagggcacagtcgctcatgcctgtaatcccagcactttgggaggctgaggtaggcaggttacctgaggtcaggagttcgagaccagcctggctaacatggtgaaaccctgtttctactaaaaatacaaaaaattagctgggcacggtggcacgtgcctgtaatcccagctacttgggagactgaggcaggataatcgcttgaaccctggaggtggaggttgcagtgagccaagattgtgccattgcactccagcttgggcaacaagagtgaaactccttctcataaaaaaataaaataaaataaaataaaaaagatagcctttccctctggatagtgataaccctaaaaatagtttaatattttctctatcaaatgaagcagtctgaaaattattctttgagtaaagttataagaatactgaacttaaaagatattgattacacagtctatttaaagatacatgcatgcatatgttcattgcaacactatccacaatagcaaagacatggaatcaacctaaatgcccatcaatgatagactggataaagaaaatatgtggtacatatacaccatggaatactgtgcagtcataaaaaggaatgagatcatgtcctttgcagggacatggatagagctggaggccactatccttagcaaactaacataggaacagaaaaccaaataccacatgttttcacttgtaagtgggagttgaatgataagaactcatggacatattggggagaacaacacacactggggcctgttggagggtaaggagaaggagggagagcatcaggaagaacagctaatggaatgttgggcttaatacccaggtgatggaatgatctgtgcagcaaaccgccatggcacatgtttgcctgtgtaacaaacatgcatatcctgaacatgtacccatgaaattaaaataaaaattgattataaaaccaaataaaagaatatatttaatttaaaaaatactttatgtataaatatacaatcttctaatattaatgttttaatactatttaatatgataaatcttttgataaattagtatttgtgattcaaataatttttttaatccagaaaattgacgaaaatattatcttaagtcacagaaaccgaattaaaagttgcttaaaaatatcaaacagatttctggagacatctgaagtggtactagtaaccaactccaaattagttatttatgtaaataacctgtttcttggtattggagtcttcttgtgcactgttcaataaatagtagaccccttcggatttcaacatggatgacctcccaggcacagttgctataattttggtggtgtaagtagttgtgaatcccttggaaataattttttagtctaaatatggtattccccctttgcaagagtgaacggccctctttcctggtttcctgctccaaacacacctctgtcttctctatttgctgataaagtctacttaggaatctctccaagctgctttcattccaaaaagattgggagacattaaggctgaaagtgttgaatatctgctgtaacatttcttatttggcaatgagggcattttcctttgaaaacaggttacttttagaaacctggaagaatctgaagttgctcctgtcctttagacattgcagaggaaatttttctcctaggttttttaaatgttctaaaatctcccagttgcccttgcacctttgaaagtgacagtccagagagaatgcagtagtggtgagaagtagcaccaaggcccaatccagcaagcattgactagtcatgttgagttccttcacactgctgttccttcctataagagagctcaggtatcagctctgactgcaggctccacatctccaaatttatatatctgagggagctttgttcttgcacggtgtttcaggatacctctactggtactttcatgtggtctttgccacttttcatttactattttccaaacataaacaaaagctttgtagcatcaccagacagcaatacatacatttacttttataatgtgatggatataaactatcttctatgaaagatcaaccatcagttacatgacaacaaagcagtggatatccttgccttaatttgcatttttatgcatagactgtactggcttgccttcatctacttaggcttgtcgttgttccaatcaaggatgactctgggtgaaatgctcgtttagatatttggcatggttttcaaggctttgttttagctaattgtattttatcataaacttatatttcaaagcccttcaaacatggcacattgtttaacctctctgccaatttcctgatgtctaaggtgaagaaaatattatcacagatggttgttagcaagattggtgactgatgattggcacggaggaagtgctcaatcaatgcttattaccataatgaccataatcaccatcaccatcctcttagggagaagaaggcctagctgcccctgccactgacacacttctctctggggtttttgctctgtaagggcaagaatgttgcagagacttgtggatgaatgagtactgaagccagtcaagatgctgttttaaaatcctttgagattttatgctttgtaattttatttaactagggcagatggtagtgttgaatgcactgtgaacaccaacagttgatcaatgagtaatattaccaagagtaaggaatgaggtgagggggtgacattttttgagaataaattatgtgtgggcactgtgctagatgatgcgctactgtatacaaggcaggtcagaatacaaggcaggccagaattgtctgaagggaaaagctagtcatgatgagaaaaactaaaatgagtggagtaaaaaaccaccatatgatattaaagacaataacaatcatcctatatactgaataatatttttatataaattctcattatggactaaatgtggagcaattatacgatcctcattttacaagagaggaacctgaatctcagaaacccaatcttacctgctaaggttgggtaaaggttagagggactgtgctcaaaactggagatgacgaagaggtttaatcccaaatcaattggtactagtcttagggagtgagaaggattcagagggcttcatctgggctaggtgaaaagagtgctgtaacccgctagcactgtctgctatggggtaaggcagctccccttcgagctgccatccccatgtaaatgttaagctatcttagtatgtgtcttgtttgcttgagcgtgaatgaaacaggatataagtttggagtgaataaggggaaattaaaaaggcaagatagaaaaggtgaccacaaactatgaaggaaactggaaaaatgataatgatttctgtaggctaatcctgctttcacaatctgatattagaaaacaaaaaacaccacttttttcttttctttctttttttttttgtaatggacaatttctaagatagaaaattcagggatagtgatttccaattgaacttctaactgtgctcatggggcagtcccatagcctaccaacgttcatctttatggaagaggagcctgagcatgcaagatggtcacatctctcacagtgcttttgggaggtcatgaatggaaattaaaagctattatctcaaatatgaaatggcatcaaaatcctaaactatgcagtcctaactgcagggccagtcagcacctgcttcaccataaaacaaaaaggcaaaccatcatctctttttatttttactgcctgccctccacgttaatgtgctacatgtgcttgcctttgcttagctagcagtggaaaaccacttcccctctctgtggccctgaaaatgacaaccacatgttgttccagtcttttctctcagttttattttccaggtcttaactcatgattgccctctgggtttctgtaatggtaagggaatgttttcaattgaaacaagagttcctcccaaaatgaaagaacatgaaaacacaattcttcatcacatatttggtaaatcctctactctccatttgaaattcagaattcaggggttaaattacaagagcgctttcaagtacagcttgaaaaaactgtgtttatctgaaatcacaggcaatctttatgtgagcctgggtattaaaactgtttaaatgcagttttttgaggaacacttttgaatggaaatggagtctattgaaataaaaactttaattaaatcatcatttagctattatgaaataaagacctgatttcattagtgcattctaagttgtagttgctgttaaacatttaaaaaaaattgttttactaattataatacaaaatgactctcgagttcttttgtattaactcctttaatggtacccaggaaattctgggtgtaggatcttctcttcttttttccatcaatttaataaattcctgcttatcatcaacatgaaagtctgtttgtatttaacaaaatttaagttttcctcttctaaatccagtatattctcttattactagggcttaatctttgtttgagtagaggtgagtaacccgcatagccaataataacaactaacatttgtcaagcactccttaccttatgtatcagaaactgtgccaagggatttagatgtaatatctcattccttaaatgttaagaggtagatcattaattagccagtttttaaggtaatgaagctagacctcagagagattaagaaatttgtccaagtcacacaaatttataaatgttggagcgaaaattcaaacgtaaatgttctttaatccaggccttctgttttagatctataaaatccagcaggaaaagtcctttacattcacttataatcttaaagagagatagaaaccagataaaacattaaaactttgagtgatagaagtaaaaatcacataggctcaagcctctgaaatccccaatgggcccctaagaaatcctgtagaacgatttgcccaaatgagccagcagcaaagaagggaaaggtactgaagcctcctaaatcccaatctggtgcattttctactaatgatataggcttatgagtgagtaattatactttaaaattacatcaaggtgtaaagtagtatcattatgtgattctcagaaattaagtttaggcttataactatatcaaatagagcttatgctcatgttctcagttatcttgttgtcagggacattgtgtagtaaatggaatgtcaggatacagcgagagcaaatgactcattaggattgtgataggattggagacaatatatttcagtccttaaaactgagatagctttattattactacatgattgtaaaaatcattacctgctactgaatgtgttacatattcagaaaaaatacaaagaagaaaattcattcacaaatttatcactcagatttttaccttactatttttatatattaaattctaggctcttttctattcatatatgtatggattttcccacaaaatggggttatattatgcatattgtttagaatgtatctctgtcacttaacaatatgttggctatggaatactttctgagtcaacacacagaaatctagcataatttttcttaattagtataatttttattagcataattttaaaaattaaccttcgaaggttagaaatgtatgtttttctcctaaatttggagtgtttacaaagtctgaaccaatagacacccttgtataacaccttttgaaaatgtgtctaattcatttatgcagccaaaagacacatgaaaaaatgctcatcatcactggccatcagagaaatgcaaatcaaaaccacaatgagataccatctctcaccagttagaatggcgatcattaaaaagtcaggaaacaacaggtgctggagaggatgtggagaaataggaacacttttacactgttggtgggactgtaaactagttcgaccattgtggaagtcagtgtggtgattgctcagggatctagaactagaaataccatttgacccagcaatcccattactggctatatacctaaaggattataaatcatgctgctataaagacacatgcacacgtatgtttattgaggcactattcacaatagcaaagacttggaaccaacccaaatgtccaacaatgatagactggattaagaaaatgtggcacatatacaccgtggaatattatgcagccatgaaaaaggatgagttcatgtcctttgtagggacatggatgaagatggaaaccatcattctcagcaaaccatcgcaaggacaaaaaaccaaacaccacatgttctcactcataggtgggaattgaacagtgagaacacatggacacaggaaggggagcatcacacactggggcctgttgtggggttgggggagggggtagggatagcattaggagatacacctaatgttaaatgatgagttaatgggtgcagcacaccaacatggcaatgtatacatatgtaactaacctgcacgttgtgcacatgtaccctaaaacttaaagtataattaaaaagaaaaaggaaaacaatgtcaaagaaaacaaaacaaaacaaaacaacaaaaaggaaaatttgtctaattatttccttaggacaaaatactagaaaatgaattgctgaatcaaagggaatatagttttaaggcttttggcagccttgttttctgctgccctccactatcataccaattgctaaatatttgaatatctagaataatataatatgaaaattatattattttgtattcaatgcatttttttatactaatgttgggtgcttgttatttctaaagcatggagtcaatgactattggttgcttttcaaagctaattgatgtttgacacagattcctacacttttctaaaaagcaatctctctaaaataaatttacaagggatattcttattctcatttatagatgggaaacctgagaagaaagaacattaaaggtactgactttattgactcagaagaaattagtttctttccaacctagaccaggcactgatcaaaagtactggctggctctcaccaaatggaagagtgccagatattctaacattggtcactttttgtgattcttcttcttctctcctttttaattttttttggagtttgcagatatttagttttacttttattaaaaatggttttataaataaatttttttattcacaaatactatgtgttcaatactgatgttaggtacacttgtaacaattccatcctgtttcacctgcctgaagtacaaaaacaagctcacattcttctctctacagttattactgcatcacatgcacaagtgtaagaaagatttatacaatgcaattaaatgaaaaaacattctttctcacttttccgtccctacttccaatctacggaagcaacttgtttttcgttttgtttcttttcttttgccatttattataaaccatgtaaatctacataatgtaccaaaatccttattgatttaccaatttagactatagcttttgacttcatgttctaactatagtttatttatatcactttccacctctcctcttttctcccgtattttgttggatattgctgcagctgtttttataactattacccattctgtatttctttgttttccttattaacagaggcaatgtgtccagctataaacacattctaaggctccatatgaaatatcagaaactctgagagatcttccacttcctaattcagataatacccctcctacttgatgaaatgtggaggcaatgcttgcaggtacaaccgtcatgttatagccgtgagttgacaaatataacagtgacatggtaaaaataatagagcagaaaaagagtgcccagctcccaggcacatcattagaaagctggcctgctctaactgcctccatctagatcttttgtaggtggagaagacaaacccctttagtttaagctactgctaataaggctgtttgttagctgtagctgaatgcattcctaacagaaatagttatattattttcattcttcattggttcttcactgataactttataagtataataaaataatacactgtaggaatacatgtgagtataatgatacacttaaatctcttgtttcttgttttatcttcattagacaatatcttatgactgattccactctttaattatgtgtttactgttatattcaaagagatgctggaacgaggaagaggttaaagagagattatttgccatcttgaactaggaatatcacatctcttttgtatacttaattggctcaagcttcacatgacctagaatattttcccctttcctctggggtactttcattctgtcatatagctcagatgctctaaaaagccagtgtttctcccaaagcatggatagcaggatgccccacaccacaacgatctttgttagctattgtggccctgtgctactacagacctggacttccattgctggagttttcaagtgtatgttcacatttatccattattttcaaagcagattccaaaaatgagggtgattggatcaagagagatatattgtcggtcacatgaagtgcctggaagatgcttttgctcttcttgcatggtactcagctgccagtccagattcttccatctctcatggtgcatttcctcttgaggagcccttgatgattcctggaagcagaaagtctctacccatcaaaaccagaacaatcagaggcttcagaattttttttatttttggctggaactgtcttagtttggggggattgtgtatagtataatgaaagtattggcagccagtaggttagatgaagatgaagattgcctctggtggaaccaagggggatttgaaaagggtttacctttcattcagatctatgagttatgtattcaagtattcattcattcaacaaatgttgataggtggtgtggtgcaattagttagttgtggaatcagaaagaccagcctgtccttgaatacttcccctgctcttcactgatccctgaacttgaagcagattccttaattctctactacttgctttcctcctttcaaacacaatgaaaatgctatcttatagcaactcaagggttagcaataatatatgtaaaatactctttctctcttctctaatcacggagcaataagggtgtgattcctgagtggcccagtccccctgcctcctcagggagaagtataaagaaaggaggggagaaaagatttctgatagaggaaaatctccaattcctgtttctgagacccctgagctgcccttcctgcaacaattgctttgatgctatgagcaattctattcttgcaatagatcccatttttacatattgtggttggagttgagtttccatcactttcagctgaaagggtcctgagggtggcagctgaaatcctcttttctttgagggcatgtggattatttggtgaaaataatgaaagctgagggagagaaggcaggctcatcactacgggtaaagcaggttgatatttgtgattgtctgctttgccagctagggaacccagtcctgggcgtcaagaaggacttatcttcattctctgcttcaatagctctctaaaacctctgtgaacatacttatcttgcctttaactgctcatcttctgcaataggactgagctccctgagggcaggccttgtggctctaatgccttgaatgttataagctgtccaactcacatgtgtagaatgaatagtgtgtaaataaatatacagaaaattaagaatttctcaattgtcactcatgtgaatgtctcctaaatacagtctttccacttaataaataaaaagttactaaatagtaccattgcctgagccaattaaagttttgcatatcttagaaccttgcctctgctatttactcaccagttaaagcaaattatttaagttatcaatccccagatctctaatgtgcactttgacaagtatatatatatttttgaaattcaaatgctgtattgagaaagatataatccatgcagagggcattatgactagtgtgcttctgggttaactgtttggccaggagggaaataatattgcaactagttgaagatcatcgttttggagcacctccagaccttattactgcatggtcagacctgggggaaagaatgaaaatgtatttccttctactttggttcagttgataggctattctctattggagacaaactgtgtttcacacacaaccagctgggtgaccacttaatatcacagcaagatgcaatcaggcagtgggttccacagggtccagtcttctcccagttgatcgatgggagcagttcattaaggtcaaaatatcagaaatgtaaatagttctttcactgcttccctccaccactgttttccctttgggttattatcatttatcacttctggcaaatcaaaaagagagagagagagaggaaaaaaggaaaaatcagaagaatgtttagactgttggtgaaaatgctgctgctgaataagatgatgtctccttggaagttaccacagcttgatagccataatcccttctcagaacctttagaaggctttgtggccctgtctgagtgttcccaagttattccgctggtgggttgcctgtgtttttccattcccaattaatgactggataaggaagtaagaacagaatagggaacaggggcttattagggaccagtaacggttccctgtgacaagacatctaacagatgaaacactgttcctgtcatccttttcatttctgcatttatgtggctgggttaccaggagatagggagagagatcagtctagaagtccagtatggggcaccaaagctagtgagatttccagtgggaggctgagttcaggcaacaatgtctgtgaaactgagcaatgaaagagagaaagcttattggacatgcagtcagaagataagagcctaggtcattttctaattatacgaatatatttgagatgcccatggactttgtgttaggctcttattgaccagacaattacatgatcatggtgtcatggtgttgtttttaattacagagataattgtctgaactatctgggaatttctacagattttgtgaaattttactttggatagggatgggatgctttaaaatagaggctcttatatttcagcaagagaataataggtaacaattgcctgcaaagaagaaaaaaagctaccatttattgatagtatatgccaggagtttttctggacaagtcctacacaggtagtagatgcaatggagggttatttacctctcccacttccttctttatacatacctgccaagccaatgggagcctgagatgaagtcaagggttttgaatgaagcaatttgaaaatgaacccttccttgtcaactattacagaaagtattataatataacccagggaggttgagcacttgcgacttaataaacacaattaaaccataagaaataagaacaaatttagataaacagaaagaaaatgaatttttcatgcataccacatttattatttcaggggtgtggcttatagtaggaaaataatccatggaactcaaaggtatattggagtttaggagagatcccgttgcagcctggaggggaggaagctgtattgaatattgctttcctcccttgtgtggcctactcttccttaatagatgctaaggtgccacatatgcctgatagacaccaattggtctaaagccagttcgccaaatataaaatatatcatgctttaaactatttataaggcttataacaaatataatggaagaagttattttaataacccttgaatatttctatggcattttattattttaatttattttttaaattgacagataaaaatggcatgtatttattgcatacaacatggggttttgaactatacatacattgtgaaatggttaaatctagctaacaagtgcattatctcacatagttattattttttgtggtgaaaacacttaacacccattcccttagcatttttcaagaatacaatatattatcattaacaatcaccatgctgtacaatagatcctttgaacttattcctcctatgtaactgtaattttgtattttttgaccaacatctccccagccctctcctgcccatcccaactgtcccagctctggcaaccatcattccatgctctgtttccatgggattaacatttttagattttacatgtaagtgagatcccgtggtatttacaaggccctgtgttggaccaagtcatacatcccattttttgcatttatttctcatagaaatcttgaagagtttggggtatgattgtttctaatttatttaacttgcccaagaccatactggtacaaagtggcagaacccacagtagctctcaggtttgtattatttcatgccctgtgtttttgccatcagagtataggaaacttaaaaaaaaaaaaaaaaaaaaaaaaaaaactttgtactttcaatgcacagactttcaattcatgcatttctagattagtaaatcattttctgctttgaaagttatttgttttacctctggactttcataaaaagaaaatgagccaagaaattaaaaagtgaaaggaaagagaaatttgctgtgtatttccattaagtaatgtaagccattttagtttttaagcattcctgtgagataacaaaatcagcttgtgtcagacttgagagggaaactgcacacagggctgtcttgctagtacatggataaaaatgtagtgctcaagagaaggaaatgcagccttgccaagggaaaaacgatgactcatgattcagacagttgcttacaaaaacctttggagaaaatattctccgtagagtctggcaaaggagcaaatgggaatttcctgctattctctttagaaaaaggaagagagagagagttcccttctgcatggggatggaaggagaccaactgcttgagtgaggacagcagtcctttctgcaaaagatccccacaggccactggacgttagtgcacccacttggagcaaaaccaggagttgtgctgtgcatgagctgccgggcagtagagcttcttgttccttctctaaattgcaatatttgtgctatgtagttgggtaaaaatagcattttgggtggtagtagatgattacaggtagttaagagtatagtccctggttccaaatatgtctctgttctttacctactgtggatttggtcaagttacttaaccttactgagcctcagttttcttatgtataaaaaggagagaacaatacttacctcatagatgttctctggatgattaaataagatggtctgtctatctatctatctatctatctatctatctatctatctatctatccatccatccatccatctctctaactatcatctatcgagctagctagctagctagctagttcatcctcagcagatcccttgcagaaagtaagtccttaagaaatgtagctgttattgttgtgtttgcattgtactatcattgcaaatatttccattatgaagacacaagttaaaaatagttgccttgatgatttctcatgaaattaaatatggaattactgcatgattcagcaattttatatctgggtatatagcccaagaagtaaaagctgggacatgaatagatatttgtatacccatattcatagcagcattattcacaatagccaaaaaaaggaagcacactaagtatgcatcaatggaccaatgaataaactaaatgtggtacacacacacaaacacacacagccttaaaacagaaagaaattcagaaacatgcaacaacatagatgaaacctgaagacattatattatactaagaagaataagccagtcacgaaaggacaaagtttatataattagtcatatgaggtaccaagagtagtcaaattcatagagacagaaagtagaatggtggttaccaggggcttggagaaggacaaatgaagagttggtgtttaatggcttcagagttgcaaatgaaaaagatgaaagagttctggagatgaatagtggtgatggttgcacgacaatatgaatgtacttaatgttacagaacttaaaatgtaacttaaaaaaggtttaaatgctacattttatgtatattttgccacaatatgaaaatgggaaaaatcatttccttaagcactggaatttgtaatatgtaacttgtattgcacttggtgcagatatgcaatgtgtgaagtgctcttggcttttccccccatagttttagcacgcagggatcgtgatccacttcttggactatcatttaaaatatggagtattgcaaatgtgccataagtaaaaacttttaacaatctaacctctaactgacaatgaacttagactgtaagataattttttatttctaagagcctgttgatttaatctcatcttggagtcttataaaagagatcttaagacatcaaacaatgtatgttgagtttaacaagggaacacaacaagatgctttggctccattttatttatttttcagtaaatttatacttttttatttttcgagaggtttcagtgaagtacaatgacatgtaataaactgtacatatttaaagtggacactgtgataagttttaacatgtatatacacccctgaaaccatcaacacagtcaagatagtgaaaatgtccttgcgctctcaaaagtttctttgtgttgctttgtaatctctccctccatctcactcctcagtactactgcccccacccccaggtaaccactaatctgctttctgtcattatagattaattttcctttctagagttttatagaaataggccaatacaaaatttattcctttttggtctcttttcttttctttttttttttgagatggagtctcgccctgtcacccaggctggagtgcattggtacaatctccgctcactacaacctccgcctcctgggttcaagtgactctcccgccttggcctcccgaatagctcggattacaggcaatcgctatcctgccctctaatttttgtatttttacagagatggggtttcaccatgttgtccaggctggtcttgaactcctgacctcaggggatctgcctgcctcagccttccaaagtgctgggattataggcatagccactgtgcctggcccttttgtattcagcataatttttttggagattcatccatgttattgtgtgtatcaatgattcattcctttttattgttgaataatattccattgtatggatatactacaatttctttaatcatccatttgtgatggacaaacaaagctcccacaaacattcatatacaagtctgtgtatatgaatgtttatacacagaaaagaatcctttcttttctcttggataagtactagggagtcgactggttggatcatgtggtaggtatatgattaccttttttaaaaactgcaaaaatggttttccaaagtcattggaccactttttgaaagttctagttgctccacatctttgccaatccttgatatggtgagtccttttaacttcagccattctaataagtatgtagcagtgtcttattgttgtttaatttgcattacattaaaggttaacgttattggtcctttcctgtcttgtttgccatctctgtaccttctttcctgaaatatgtgttgaaatcttctgtttgtcttttagtgggttatttgctttcttatcactgaatcttgagaattctttacatatcaatacaacttctttatcagagaggtgacttgcaaatatattctctcagtctgtgacctgtcttttaatcctcttaagagagtcctttgaagtgggctccatttttttaaaaattcgtaggctaattgttgggggatataatttgaataatgcgttataggttttctaggaacaccctctacatgaatgtcaaaacagaataataactgaaacataattgtctgatttggtgataactatgatgtgaacatgtttttggagtactctccatcaggtcaattaacgagttaaatggttaaatggatcctactaaattaggagagtataattttgtgctggcactactagtccaatttttgagtttgtcttaaactatcctagtaaattttaggcaattaaactaatgtttaaaaagcaacaattaatgttgagaacaaaaggactcataaaacagttcattttttaggctcagcaagcaccagtgcaatgtgtttagagaaaatgtctgcagtcaacaaggtatggctctgggtgacattcatcttctgactctattaccagatgctggctctctctgtgtttcccacagccaaacccgtcaagaagaaatccatgttgatgagggcccccacagtctgtgcttggcagacctctcatgcatcagaaatagagcttggccaagagggctggtgaactttgctcagaaaggacagaagctatggcaggtccccatgatggaaagggctcccctgggaccaaatcatttcacattcattatctgacctacaccaccaacaatccttgagaaagattttaccatgttaatatactaatttgctatttgcatgtcttctttgatgaagcatctgttccaatatattatccatttttattattttatttattatgtattttattgttttattagtggttttgttattattgagttttcagagattttaaaaagtatattctggagatgagtcttctatcagatatgtgatttgcaaatactttctcccagtctgtggcatgttcttttcattttcttaagagtattttatgaataagttcctgatcagatgttatctgaatacttgaacgtgtttaatgccacctaaaatgcctaaataacacctttgttgactgcaaaaaagactatacaaatgtgtgctgatattgccctgcatctgcatgttcatatatttaagcaaaattcatatatttgtatgtaacccagatgttcaccagtgccttcttactgttcaagagctagataagacagttccatctcctaatccagctttgtggattcctaaggtgtgatatgggaagggggaaggtggctgtgttgtcattgttttgcctcctgtttcttctaatttggttcatctatgaagatctggccaccccatgtttgttcaaacatgagaccgggcactttctatgatttgtacacagaggttttacgcagaggactttttgtggtagccatttttattgaagttttggagatgatgtcggacagagtttcaatacatcagcgcacacaatttcatgctgcacatgagctacgctgtttggaaaattcttttttcattcccaccagcaaaattttcattgtctgacttgttccacgtagtgtcacagttccagagctttgggggatttctgtctgtctcctttctccttaaaagctgacacacaaaacatgctattgatattttactgtcttttccgttgccacacccataacctcaaaatctcactagatattgagtgaagcctcattagatatttttctacagactcattagatatttttctaaacaaagagtgttttccttaagaccttattctggtgccagccaaagtaatattattattttactttattcctcatgcctagtcatcggttcagcacatgcaaatgtgcacctttgggctagttgccttcatttttattggaattaattttaattgttacttatcttctactggttatggacttatttttggcattctggatgggttgacatgctaagctgtgatacagtatttctaattctgcagaagtggcctctctcctgtcattcttgccccaacacggaggtagagcaggtcttttcaagaacttgccagtttctgggccagtttagcagttcagctcagagaaagcagtggacaataggggcccattgctgagagagatttctttagtttcctcttggctgctctagacactgcctggactccgcattgctacttgctgatcttgtccttgactccaggaaaaagaggagttcggctacagaagggcttttggcagagcaggggtggagagctgggggaaggatgaagcttgaggggggcttgactggtttgagtcaatggcagcaggccccccatgatgacatttcttgtttgcatagcccgtgtgtgtgttatccactttgaactggaagggggagccctgagttcattgtctacacaatagtagcttctctggaactcttaatgaacagattacttctcctgaaagctgcttcttttaaaaggaattcagatttctttactgctctaggaaaaaatgcctagatacaaataaagacttttatgatgcttctctttgaacttctttttaaaatctccattcactagagactgaatgaaatcattatgtgaccatgggcagttactaaatttctttgagatttagtttcctctcctgtaaaatggcaataatgtacttgtgcctacctgaggggtgcttgtggagaagattaaatccgattatctatgtgggatctcagcacagtgcctatttcattagaatttctcagtaaacagcaactgctaatggcagtaatagccactataacccaagttcccgagttttggtacaaagacaaaaacctaaccagtcagtccatgctgaccaggtgcccaaagagctcctagaaaagcttgatttttttcccggtgtaagccctgggaaaaattaatgccctctctatcccacctaaacttccctttctcctatgtttcctggctttttgcttggtttgaaactggacttaaactgctgcacctctttcatttggctttaggaactatgtggcgtccgcaatgcagagcaacagaaaactggacaggacattcctggaattctgtatgaacaaggcagtggggactggaagcaggcttagttttttgaaaaactagggagaaaactaaccagatggctagggtataaaaaggttcttcttcctctgatgcctgtgccatgccagcagacagggacccacagctcccctaagatacccacacatcttggctgtcccatgatgagcagaataaagagattgctgcttaatagtgtcatggaagtaaatgggacttctcacccttaagcttgcagggatggtggggggcacataattatttaaaaatctttcgaggagcaaagtatcccccaaataacgtgggaaggttagggagaacacaaaagctgacatattcctctggctattcctgatggccagctcaattctaactttatgatgagagaatctggagcacacagtaggaggaatgggaaccccaggtttagttccagaccctccagctttccttttctcttttaatcccacagcagttcatgccatatttattcccccataaggttcaggtccccttattgtctcttaccttatatattccacatggctttcttgaattttaaattccttaaaggcaggggccagaaagtatactactttgcaggtatattttaaaaagaacaactaataggtacttggcaattttataatatggatggttatataaatcaaatcgaaattaaaactgccatgttgacttttgcaccaaaaataatttattttccaaaataaaatttaaataaataaaaataactcataatttaataaaaatttcaaaatcttctagtgtcctttcatatgcagtacattagccatcagtcacttaaacagcatctgctggttgaagaatgcttgaagcaattgtccagtcccagaggcacaggctaggagatcttcagtttcggaggtaacctgtaagtctgttaatgaagtaaaagttccttaggatttccactctgactatggtccaggcacagtgactgtactccttggccttcaggtaatgcagaatcctcccataatatcttttcaggtgcagactgctcatgagttttcccctggtgaaatcttctttctccagtttttcttccaggactgtcttcagatggtttatctgatgatagacattagccaggaggttctcaacaatagtctcattccagccagtgctagatgaatcttgtctgaaaatagcaaagatgttctggagcatctcatagatggtcaatgcggcgtcctccttctggaactgctgcagctgcttaatctcctcagggatgtcaaagttcatcctgtccttgaggcagtattcaagcctcccattcaattgccacaggagcttctgacactgaaaattgctgcttctttgtaggaatccaagcaagttgtagctcatggaaagagctgtagtggagaagcacaacaggagagcaatttggaggagacacttgttggtcatgttgacaacacgaacagtgtcgcctactacctgttgtgccagagcaaaggcttcgaaaggttgcagttagaatgtcctttctccatgggtatggcctatttatatgagatggtcctctctctattcagaggaatttcccactttcacttctccctttcagttttcctatgtcatttacattttagtagtttctaaaactctttatttaagctcctatcttatgatatatataatagggaaaaagatttacaaactgtgaggttttctaatgttttttaaagtttcagtgaatgactaaagcaaattgtaaaacaagacttgggagaaagcaaaggaaagcaaacgacctgagaattcaagaacctcaaaacactaaaagatacagttggtccttcctatccataggttctgtatccgtggattctactgactgtagatggaaaatattttttaaaaatacaataaaaataataatacaacaacaaaaaataatgtaaattttaaagatacagtgttacagctatttagcatttatattgtatcaggtattataagtaatctagggatgatttaaaatatacagaaatacatgtgcagattatatgcaaatactgcaacgttttataagagggaattgagcatcctctgattttggtatctgtggaggcagcgggatggtggtcctagaaccaatcttctttggatactgaaagactgagagatagatttactgaaaagtcaatcagggaatagtagctgaaactgcaaggagttttgcccaatatgataatagattagtgtgagagggccttggaaacttctgaaaggcactggaatagtctagggtataagaaattttcaaaccaaccagtcacagcccttttgatcctacacagaggagaaactgccacaagtggaatcacacttcagcaggatataaacaacacagacaaggatagagaaggcccaaccagggtgggatggagaactcagaaggcaggctgctatgtttttgaccatttcacaaaagctaacagaagagggagctctgtgaagttagaaaaaccgccctgaaccacttcctggttcaggaaaaataagctcttacaagaccaaacaacagaaaagtattaagatggaatctcatacaaagttattaatagaaaaaagagaaggctttgggaagatggctgattagaagcagttgtggtctgtggcactctgctctttggccaggatggtctgactgccctgagcctgtcatgctgtgagaaagcccaaactagcttacaaggagagaccatgaaaattggcagtgtatttcaaaatttaaaatttcaagcaatgagattgttcctttaacttgcaataccgttactagttatttactatggctatccctgcagaaatatgcatgtgtatgtgcatgtgtattatagatacatacaaaacatatataaatgttgattatattactatcatagtaacaaagacaaatgtccatcagcagggagcttgtcaagtaatactatcacgtggacaagatggaatattattcagccatcaaaaaggacaatcagctgatatagacacatatcacagatacatttagtgaaaagagcaatacacataagaaaggatatgatattatcatttgttttgtaagttactagaaaggtatacatatgatgctgttatatgcatatgattttttcctttgggtagaattactatctattaatagtagttaccctggggaataatgctgatggggtgaggatgcagcaaggaagaaaaatctttatcttttcacttcatacctttagaactatctgcatatgagtttttccttgtaatgagaagaggtctgggaaatagggttattaggccactagggaattaggttgttacatttgtaatttcgtgcacttggagaaaatttaataaatattactaaattttaacatttattttgttttatttgcatttaaaatgttctattatgagcatatattatttttgtcattaggaaatttgaaagacaccagttaatattgaaaaatagaacataaaattgtacatacaacatgattatgcaaaaatatgtagagaaaattaataaaaggaagtaaaccaccattttaatagtggcttgatttggcttgtgaaactaaagagtgatttttttcctccttttattctttgtattttccaattttccaccagtaaacaagtattgtttcataatagactaatttacattataaaataaacgagtcccaacctttctggttattctgcctctctatgggtttcattctctctggccttttggcctttgcaggccagctcttagcaagaccttggccatctcatgcattttaaaaacaatgagtttcagaatattaaaaaaaactcggctcttccactcaaaaatgtctgttatgtcagtatttgagtaattccttggggttttgacgagcattctcggattagtctggaatcatccatggctcatagcacaaaagccaatgcaaggagcttcagaggttagtcaacctagagatggctgtccctctcaggaaagaggagacagtctatagagtctggtcactggggcctgctcctatagaatgacttgcaggcttgtatatagttgacctttccaggtgcaacagaaggcctcatcactgcccacatcaaatggtctcttatcctccatccggaaatggtccttagagagttcataatctaatacaataaaaacaacagtagtggcggtagtactagttatcatttattaagcacttgctatttgccattctttgaataatcctcatagtaaacatttgagatgggttattatcatccccatcttacagaggagagaaatgaggcttagagaggctgtgtaatgtgtgaaagatacacactgctaataacatgggtagattgcacttaaaactgtgatctttcctgtagaatatcaagcagtctatggctgacatcttcagataggttcatggtgtcaaccatgatggtgatgatggctctcaaagaaaaaagaaactacatctagtggagaagatgaaaaggcattcattgcccttaatgcaggcagtgtgcctaaagaagtggtatgatcactacaggtagaggtggctgtggtgaggtgatgtggttgagggcattcaatcggtactgtccaataaagtcacataatgcaatttaaaaagctctagtagccatattgaaagaggaaaagaaacaggtgaagttaattttaataatatgttttatttagcatagtatatccaaaatattataatttcaacatataaccaatctaaaattattcatgagataattaaattttgtgtacagtcttcaaaacataatgcacatttttacactcacagtagatgtcaatttagactagtaccatataaaatgctcaccagccacatgtggttcatggctagcatgatagacaatagataccatgatatccacagctctagatagacagagaccagcacaaacacagccaggagaatgaacaagtttgcaggagcaaagacaaggagcttcaattgtggacaggcttcattttaggaatcaaggaggctgagggtggaaaagtcaggttgagctgtattacggagtcttgaatgccagagtgtagcatttggacttaattcaagaggtctttgacagagaagagactggagttttttccctgggcagaacaataggcagaaatgttagaggtgattggaacagggagaggcgaggagaactcctgcccagaggctctcatggctgtggagggtgaaaataaaggccatagctgtggaaatggagccaaaggaatggaaacagaaaaataaaaagggattttttttttctggtttcttctctttgttctctagctacttcctgctattgtgttcttgaggtgcttcctaatactccacttccagttgcctttatggagtttctcctctaccccttctcctgaggattagtagtaatcttggcagaagctcacctatgaatgggttaaaatttcttccttttaaatacatcattttaagttttagcttcatttctcttcttttattagagttgtatcagaataaccaggaaaatttatttaaccttctgtctaccagggaaacctatttcttagaccagcccagtgtgtatctgcattgtaagggttagtgcccgaaccctttcctgtcatctttccctttgttatttgtcccttctgtggacgttatttttgcacacatcctttcctcccctcgttaactttccgttgtatgagaaaactacttccagtccctgcaccagttccttgtggttaatgaggtttggagagacagagtgacatttagaaagtaaaacttgaatgacatttctagtcatttgaaatcactttaatgtggaaatgcttttctataaatttcagagataggagccaatttgtcctcctcttttgaatataattatctatgcaggactactatgtatctagaaataaacattttagttgtcttctcttcctcctccttatatcttcaattatttttcaaggaagagggtccctatcaaagaatgataaattatacaagatgaagagttattgagaggtgcataagcagtggcagaacataaatgaagccaaaagcaatctttcagaaatatcttgggaagccaacaaactctttcataagagattaatacataaaagggagaattcccatttcctcttttaagaaaaagtttataaaacaataatatacatagaaaattacgcatacatcttaagtatatagctcaatgaattgttataaaataaaaacgtctgcactcttttgtaaccacaaactaaacattatcaacacaacagaaatcgccctcttgttccctcttaagtctcttggggctgctctaacaaaacaccatagactgaatgccttttagacaacaagcatttctttttatagttctggaggttggaaaagccaagactaaggccctagcagattcagtgtctgatgagggcttgctctttgctttgtgccttctcattgcattctcatatggtagaagcgggaaacaaggtccctcaggctcaggcttcttttataaggcaccaatcccatttgttagggctcttgttccattacctaattatccactaaaggacccacttcttaaaatgattgcattggggattaggttttaacatgtgaaatttgggggacacaaaccttcagactatagcacctcgcaatcattattctctctcctctctctcgtcactactttcttctcccaaagtcactaccatgcagtcttttaacactctagattctgtctgtttttgagctttgtataaatggtttcttaccctcaacagaatgtctgcgaaattcgtctatcttgtgtgtatagtttattaatttacattaatgtgttttaccctatttagaagtataccacaatgttttatcccttctactactaataattttttaaaatatttgccatgataattaatgctcctatgaaattccttgtctgtattttttactgcacaatagtacatacttcttttgggtatatgcctagaatgaagtaactggctcatagaatatgtatatgttcagatttagcagataatattgtaatgacttcccaaatgtttgtaccaatttacattcttactaacagtgtttgagaagttccagttgtatcagactcttgccaactttgatattgtcagtctttttaatttcagtcattctattgttgtacaataatacttcattatagtttaatttgcatctctctgattattaacaagtttcagcatcttttcatatgtttattgaccatttggatattttctttgtgaagagcctgtttcaatctcttgttgacttatcagattttaaaaattatatgcagatgatctaattgtttacattcaaaatacaaaagaatttatagataaacgattagaattcagcaaggtcgccacgcacaagatcaatattaacaatcagtcatctctctttagcaataaaaaggtgaaaaattacattttaaaaatgacaccatagacgatgtatgaaaataatctacttggaaataaatctaggcaaagaagtgcaagactgttacccagaaaacttacaaattgtaaatgagaggttagtgaagatttaaatgaatgaagatctaaataaacttataaattgtgagagaaattaatgaatgtctaagttaatgcagaaacggagagacatactatattcatgaactaaaagacttaatattgtgaaggtatactttctttccacataaatttgtagtcaatatgttcaccccaaaaaagctgtttgttaacttgccaacctcattctaaaatgtatatagaagcccaaaagacaataacaaaaatattcttgtagaacaaaatgggaaagaatgttccactaaatatcaagatttagagcaaagcatgagatgtgtggggatagacagtgaggctgataaaatagagtagagctcagaaacagacccattgatatatgtaagtgacctatgaaaaaaatatggcattttacaatgggaaaatgatgatctttttcttttttagaaaaacagggaaatatatttatatgtaaaaaataaaagggaacccatatgtcataccatacacacaaaaaaattccagtgaattataagtctaaatggagaaggcaaaactttaaatcttttagaaaataatatagaagcatgccatcatgacttcagtgtagagaaaaatttcttatgactcaaagtcctaaccacaaagaaaagattgttaattagattgcatgaatattaagacttatttttaaaattaaaaaaccattaagaaaagtcaggccatagaatgacagaaaatatttgcaacaccccagtaaagagaattgtaatatgcagattataaaaagaagtcttacaaatcagtaaaaaataaaactagacaaaaatttgaacagatgaaagagaaactctaaataatcattacacatgagaaactcaatctcagaaatcagagaactatcattgcatatacactaaattagagaaatattaaaaggctaagtaacatctgtggcaatattgatggtatataaccttgatatgatgtgatgagaacagtactttaccccatgggcttcctccccaaacccttaccccagtataaatcatgacaaatatactttaaaaaccattaccctatatctaaccagtactcctcaaaactgtcaaggtcatcaaaaataagaaaagtctgaggaactgtcaaaactaagaggaacccaaggagacatgagaattatatgtaatgtggcattctgaatgagatcccagaacagaaaaagaacagtagctaaaaaactaatgaaatataaataaagtttgaactttagttttttttaaaaaagagtagcattaacacggcaaagccattttcatatttttcttgaacattaagtacaagtctataattaaaaattttttaaatgtagtctggaacattgccagaaacagaagtacaacagctatctgtgctgtcgcctaactatccatagctgattggtctaaaatgagatacatcaacgctcctccatgttttttgttttctttttaaatgaaaaactttattttttaagaggagtttcaggttcatagcaaaattgagaggaaggtacattcaagctgaggaagttttcctctattcctagtttactgagagattgcatcatgaatgggtgttaaattttgtcaaatgctttttctgtgtctatcaatatgaccatgtgattttcttctttaacctgttgatgggacaaattacgttaattgattttcaaacgttgaaccacccttacatatctggaataaattctacttggttgtggtgtatattttttgatacattcttggattctttttgctaatattttgttgaaaatgtttgtatctttgttcatgagagatattggtctgttgttttcttttcttgtaatgtcattttctagttccggtattaaggtaatgctggcctagttgaatgatttaggaagtattccctctgcttctgtcttctgaaagagattgtagaaagttgatacaatttttttttctttaaatatttgatagaattcactagtgaacccatctgggcattgtgcttcctgttttgagaggttattaattactgattcaatttatttaatagatataggctattcagattgtttatttcttctttttacatttttcagattatgtctttcaaggaattggttcattctatttacttatcaaatttgtagttatagaatagtttatagtattcttttattatgctttcaatgcctataaaatttgcagtgatgttcccgcttttatgtttgatattagtaatctgtgtcctctgtcttttttccttaattatcctaggtagatgcttatcaattttatatatcttttcaagaaccagactttttatgttgattttctttattgatttactgtcttcaattttattgatttctgctctaatttttatttcttttttttttttttttttttacttaccttggatttaatttgctcttatttttctactttcctaaagcagaagcttaggtgattaatttttatgactttctttttttctaatatagcactcagtgctataaatttccctataggcactgctttcactggattccacatattttgttaagttgtgttattttcatttagtttaatatatttaaaagtttcttttgccaaccaagattactttacccaacaaagttgaccttcagaaatgagggaaaaataacaactttccaagacaaacaaaagctgaggtaggatggcactactatacctacttacaagaaatgctaaaaggaattcttcaagctgagtaaaaggattctagttaataacataaaaacatgaacgaataaaacttactgtaggaataggaacagctccggtctgcagctcccagcgagaccaacacagaaggcgggtgatttctgcatttccaactgaggtacgcggttcatctcactgggactggttagacagtgggtgcagcccatggagggtaagcagaaggagggtggggtgttgcctcatccgagaagcacaaggggttggggaactccctcccctagccaaaggaagctgtgaaggaccatgctgtgagggatggtgctatctggcctagatactatgcttttcccatggtctttgcaacccatagaccaggagagtcccttgggtgctaacatcacaagggccttgggtttcaaacacaaaactgggcagccatttgggcagacaccgagctagctgcaggagttttttttcatactccagtggtgcttggaatgccagtgagacagaaccattcactctcctgtaaagggggctgaagccagggagccaagtggtctagctcagcggatcccacccccagagaggccagcaagctaagatccactagcttgaaattctcgctgcccccacagcagtctgaagtcaaactgggatactcgagcttggtgggggaggggcatccaccatgactgaagcttcagtaggcagttttcccctcacggtgtaaaaaaagctgcctggcagagcccactgaagcgcctccaagctattgtagccagactgtctctctagattcctcctctctgggcaaggcatctctgaaagaaaggcagcggccccagtcaagggcttatagatagaactcccatctccctgggatagagcacctggggcaaggagcggctgtgggcacagacagcttcagcagacttaaatgttcctgcctgctggctctgaagagagcagcagatctcccagcacagtgcttgagctctgataagggacagactgcctcctcaagtgggtccccgacacccgtgcctcatgattgggagacacatcccagcagggtttgacagacacctcatacaggagcactccagctggcatctggcagatgcccctctgggcaaagcttccagaggaaggagcaggcagcaatctttgtgttctgcagcctccactggtgatacccaggcaaacagggtctggagtggacccatagcaaactccagcagacctgcagaagaggagactgactgttagaaggaaaactaacaaacacaaagcaatagcatcagcatcgacaaaaaggatgaccacacaaaatctccatctgaacgtcaccaaaagcaaagaccaaaggtaaataaatccatgaagatgaggaaaaaccagcgcaaaaaggctgaaaattccaaaaaccagaatgcctcttctcctccaaaggatcacaactccttaccagcaagggaaaaaactggatggagaatgagtttgatgaattgacagaagtaggcttcagaaggtgggtaataacaaactcctccgagctaaaggagcatgttctaacccaatgcaaggaagctaagaaccttgataaaagaggaattgctaactagaataactagtttagagaagaatgtaaaggacctgatggagctaaaaaacacagcacaagaacttcgtgaagcatacacaagagctgaactgatcaagcagaagagaggatatcagagattgaagatcaatttaatgagataggtttcaatatatagatttggagaaattcaagagctaataggcaccacaccagaggcattaacagaagatgacttgacagagataagtgcttctgaaccagtgccagacaatgaggaagaagatataggagaagaagtgccaggaaacaaattggcattagacaatctggcagaagagttctgattattcaagactgcttttggcttcttttatgacatggacccctctacaacatgggcactgcaactaaagcaaatgatggaagaatgattgctaccatatatataaaaatttttagaggaacaaaaaagcaaaaaagttacacagaaattatgatttatttccataaagttacactgtgcctgctttttctgcctctctttccacctcctcacctcttcacctctgccacccctgagacaacaagaccaacccttcctctcccttctcctcctcagcctattcaacatgaagacaagcatgaaaatctttatggtgattcatttccacttaataaatagtaaatatattttctcttccttatcattttcttgttaacatgttcttttttctatcttaccttatcataagaatacagtatataatacatataacaaaaatatatgtcaatcaactatatgctataggtaaggattctggtcaaaggtaggctactagtagttaagttttgaggaatcaagagttatacacagatttttaactacacgggtgtcagtactcctaatccctatgttgttcaagagtccactataacccaaaatagcagtctccaaacaaggtctctcttggcaaactgaatgtttggccatggtacccaaaggcagaatgaagtttaaagtggaaatatatatatatatatttcaatatatctaatatattgaaatatatatattaatataatatattaaagtcaatataatacatataatatatattatattatatatatatcaatataatatatattatattgatatatatatatcaatataatatatattatattgatatatatatatcaatataatatatatatatgaagtcaagggtgactttattttgccaaaattacatgcttcccttttacaatgcatcacagaatctgagagaattagagactccaattcaaattaatagttagaactttttgcttgtatcttagcagatgtaataagccatagctatcaataaaatagttttcttgtctgtggtaatgatttaaatgaactgttttggcatgatgcaaaatttgcattggtctaataatatccactttatattacaatgtatcctggtttgggaaattttttttaaagaataaaatggatttcttgtagacaacatatatttggttcttgctttttgatccactctgacaagctcttttttttttttttgagagagagagtcttgctctgttgcctaggctggagtgcactggcgcgatctcggctcactgcaagctccacctcctgggttcacgccattctcctgcctcagcctcccgagtagctgggactacaggcacctgccaccatgcctggctattttttttgtatttttagtagagacggggtttcaccatgttagccaggatggtctcgatctcctgacctcgtgatccacccactttggcctcccaaagtgctgggattacaagatgaggcgctgtgcccaacccaagctttgtcttttaatggtgcatttaaactattgacattgaacgtgattagtgatgtaattagattaatatctaccatactgataactgttttctacttgttgctctttttcttcattcccaattttgttttccactctttttctgccttttgtggtttcaactgagcattttatagaagtctattttctctcatttcttagcatatcagttatacttgttgctatttttattttgaagaaactgttatgtgttaaggattttttaaaaagtttttattttaccttcacttatttcttctctgagaaatttgctttatttagatctaagtttctgatctatatcattttccctctctctaaaaaaatttcttttaaaatttattgcaaagcaagtctacgggtaacacattccctcaatttttgtttgtctgagaaagtctctatttctccttcacttttgaaggataatttgcaagatacagaatcctaggttggtgttttttttctaaattcttgaggtaaggtattttttttcctctggtttatttcaggatatattctttacctttgattttctgtagtttgaaatgatatgcctatgtgtaatttttccagcatttatcctagttggtgttctctgtgcttcttgcatctgtagtttgatgtccgacattaatttgaataaattctcagtcattgttgttcaaatatttcttctctttctttccctgttttctttttctgatatttccattacatgtatgttacacattttgtagttatcttacagtctttgcaattctgttctctttttttcctagatcttattctcttttcttttcagttttgaaagttttcattgataaatcctcatgctcagaaatttttttcttcagctttgtctggtctaccaataataacatcaaaggcatttttcattttttgtttgatttctgagaacttctgtctaaactcagcttccagtaccatagcagctagcagccttgccctaatgggaaatgaaaggaaactggtcgtgggtgttcacaatttgccattcacgaggcagttctttttcctggcagatggaataatggttagatatccaacccatgaccagcggatccctcacatgggaaacctgtttatactggcagatgcctgtgtgaattttttctcacctgtgcacagcttatgcctgcctgaccatctccctggtcctaagagcctgaacttgtcttctccccagccacccagaaaaaatctggcatggggcaactcctacttcttcaaatttagtacaccaccacaataggcaagaagttcaaagacttttcttatagctactaggaaggaaaggtgtaatgaggcaggaatgaagagttaggcaaagaacgagagaaatcacgagggcaactggcagaatatataagggaatagggtatgtgtcactttaagttcacaggaaaatgcttgaatgatttacaggaaatggccagaaagcagggagcccagtctgctaggtgggagagatgccactaagttcttctctctgaccactgacttaggccatttgggtgtagtgtagaactataaactgtgccaagggtgactgagccctgctttggtatgacaaagttaaacttagattcaaaatggatgctgaggcaacataaaattataagattccactacactgtcagactgtttttgatctttagcatttcctttttggttctttcttttcttttctttctttctttctttttttttttttttttgagacagactcttcctctgtcaccaggctggtgtgcagtggcacgatcttgactcactgcaatctccacctccagggttcaagtgattctcctggctcagcctcccaactagctggcactacaggcatgcgccaccacacccagctaattttttgtattttggtagagaagggatttcaccatgttggccgggatggtctcgatctcctgacgttgtgatccgcccaccttggcctcccaaagtgctgggaattacaggcatgagccaccgcacccagccttggttctttcataggctttccatctctctggttgcattgcccatctgttcttgcatgctgtctactttatctgtcagagcacttaatcatagtttaaaattcccagtctgataataccaacatcactgccatgtctggttctgatgcttgctctgtctcttcaaattctgtctttttgtattttagtatgctttgttattttactactgcaaataggcctttaaaaatgtgacagtaaggtattaggaaggggaggtgttctctagtcctaccagtaggtctctgtttttagtgagcctgtgcctctggactgtgaacttcgaaagtgtttctgtgtcctccctccccctttaggtggagcaggatggctagaactggctggagttgggtatttttcttccttcaagtcagttgaaaataggctctaataaaactccaggagattagattctagtcaactagctttttctgactgcagaccttgttaagaggaatggagtgcatccaaatattctcacctttattgctggaagcactagagaatttttctctgatatttcctgtgagaaccagctaaatcacctagacataaaatgcaaaaagtatgaggaccctcctataactaagtcctcttgagtttttaattctcagttgtccacactgagccttcaccaattcatcaattatagtccaggttttcctggttcccttagtggtttccactggtgaatctctgttctggtttaagctataactctccagatttgcctgcccgtttctccaatcttggaggtagtaattgtctctgtgtcctcacttctcatggatccaaacagagtttttggattttacgtctgttcagcttgttaggccagagtggccatttccaagctccttacatgtagaagtggctataattgaatttttaattcaattaagaggatcaaaaaaccaatgaaaactattatattactacatagttatttctaaattgagagtgatttttttttaaccttgatcaccaatgaagattaatcaacttctctcattttttatttttgtaagtgagcaggggacatttaagcacatggtgggtggtaagcatcattaaggtgggaaatcagactgcaacaggatgctataaaggccaggacaaggcagttatttctttcacctgataaatacacagtcatttatttaatgaatatttattattaattaatgtattaatgaatattaagtacttggtaaataatatttatatttttataggatatttaataatatatattgagcattccataaatagaaatagtgaatattagaatattattgggctattctaaaaatgtctttcaaaaaagttatgctgttggcttgatatatgtattgtgcattgtttctgagtttattccaatgtattttatgctttattattgttatattttgaagagaaagttattttttcattacctgttctaatttttaatgggaccaattttcattacatttcaggtatatgtgtctttctgttattttaagtgaacatttaaaacttcctgaattataatactaatatgacaaatatcaataaatagaaacacatgagcacaatctttttggatgtgtccacaatttttaagtgtcgatggcttctgaaaccgaaacagttgagaactgctgatgttgataagatttacaagagcctatttaggtggttaatttggcatataatagtattaatctctagttttattggttgtcttctctaaatcacaggaaaacaaatgtggaattttcctgaccatgggtagtgactgtggtgtagcttcagattgcatttggagaaaagtccattggaaaagcatggggaagggaggtaatgaggacgcaaaaggcagaagagcttcgttcaaaaacagtaccctccacaataataaaatgaagggtaatctcaccaaagtcttaattacattggaaaattttgctcagtgaccaagaaagttcctgtgaaacttgggaattacaaaggaaaagcctaagttcaggggaaggaaaaagaagaattgtttttctctcttcaacctgctgtttccctctcaccctcattcagttcctgaagctgcttctttccatgctgggctttataaccgcaagccaacagctagttgggtagggaatccaccttcagacctccgacctcgtgtgaagaggcagagcatgccgctgagatctatgtgccactggtttcagacatttctctgttccttttccctttcccacatcctggatgtcttgtcatagtcaaaggcctttgactagatccattcgttagtttccgttctgtcacctaagaatccaggagagactaggccacttcacgggggctctgcctgtcttgttaatgtcgggattcctgacatgatattaaaataacggcaccttggacattgagaaaactgcagaatcaagaaggtcattcactgactttgtctcacctttctttgtgaaagctggtcataagataattatctgtcctatctcccctgaaagtatgtcgtaagacccccatgtgacaggtgtccttccctgcttctggaggaaaggaataaagacacagggacaccaagaataatctgaacagcaggccttcctaagtcccccctcagtttattaacaatacttcatatcccctttgtgtccaatatgcttttacatgactgtccatttttcattaaacctaagcataaaaatagacagtttctctgggtctttggatcttcatttctaaagcctcttgtctcccatgaaaattagtttaaaaaattagttatggttttctcttgttaatcttcttttattataggggtattaaccatgaacctagcaataggtgagaaaaggcactacttttttttcccacactaatgacaacttctgccttatgcaaacacaaccagagggtcctacagtcttcaccgccagccacagttggaatggtctcatcaatggattgatggcccagggacgcacaagggctgtgctgaggctcaggaaacaatcccccaaaatgacggccacagaagcagcctcagaagcaaaactttctctgactttctcctgcccttctctctgtggccccttattctctagaatctctctagaatccctcttcccaaggcaggccatagaaaccagaattcccttccccaaagccagccataaaacctaaacatattacttcaacctcctccttgcctttctgtgtaaaagctgaccataaggaaattatgtgacctgccttatctgatggtagaatataactccattcagagagggccctgccccattcccagagtaaggaatgttgcacaaacaaacccagaagaatctagacagacaggccttgctaggcttcctcactcagtctattagcattagatcatgccctttttgtccagtcatttttctacatagctgtccaattcttcattaacctaagcataaaaatggtatctttgggctttcattctgaaggctcccatgtcacatgaaactactatacaattaatttgtatggctttttgcctattaatctgccttttgtcagatgatttttcagtgaagcttcagaggtcaaagggctaattttcccctggcccctacagctgcccacccaacatttcttaccaggtgctacctggactccctctgctagaagctccacattggccctatccaatacagtcttcagtcaccctccagcctgggtttacttttccctttggataccaggcatttctctgagctgtatgttatttaatcctcacaaccatactcaggggtaaatgcagccaggcctagggttaagaagagaatacacagacaacacacttacagcagctgctgaataagcaccagctccattcccttcacaaacacgtggacatgtctatttttggtttttctgtgggtgcttcctatcttggaagcagtttctggtgcttctacaaagtgaaaccaaaaccctgtacatcattaaaacttacaaccaattacatttttatttcatcatcaggggctgtacgatgaaccaggtggtgcaaaaataacaatgagggtgatgcaacaagtgaaaaggaaactaaatgtgaattgtcgaattggaattgaagaatggagcgggtattcccctttgccctggtgcttgcctgaggcaagtgctgcttatcttcacaaagcagaagattcttctggctgcctggaagatgcctctgttattttagtgaaaacatttagctcctcgaaaggtagagagaaccaagaggtaaagtgtgccattgtagacagctggtgtgtgtgccaggtagcagtgcttctgtctacatcctgggatatttgctgcgaaatgattggctcagtcaccaagtgaatggctctttctgcctctcccttgtgagtagttgagctggcattaaaaagttcctggctagttcttttgaaattacctcaccttcctgcagacctagaacattagggaataatcctctaatcagtttcaaataggagagctcacatgtaagcagccttatttaagtgccaggcatcattctgagcatgttatataaattaaacaattaatcctcaccacagttttatgaggtaggactgtggttatcttaattttacagataagggaactgggcaacgagaggtctgtttcctttccccgttatgacatcccaaaatagcattttgctccttgagttctagtaggaacattcaaggcctggttggcctttcccatctctcactctggacccctggagggaagaaaacttggtcttattcctagctctcatttttcacttatttcttatttttagaaaatgtgcaattctgccaactctttgctttagctcttgctttcaaatgacttgcacatctctgtcctttctccccttttccaaaattttcaatgtcatttgcatccttccatcagttctaaaatgctagttacttgtggatgtctctccattttacgccctgttctgagcctatggctctttgcaaattcagcacttgcggaacactcatcattctgttcggtaatcgatgttttgttttatcctctcttttccagaagattcgtgttttaaatctgaactttgtctccccagtcattagcacagtagccaatggtaaaaagttaagtattgtttattgaataaatataatgctgcaatatatgcttcaatgagtttgtgactgtcagatatcaaggagttgtcttggcaatgtttgctgagggttcatttaatgaattctcttgacaagaatttgagctccacctatctcatgagcacattgatgggcaatgtgaacaaagggaaaataaaattcaaaagagaatacaatttatgttgaaaagaacattaaatattattttagataaatgtagccccaacacatgtgagtcttcttgccccttctctgactctcttggcatccaaaagaaatgcaaatccataatcaaaagtctttaaattttaatatagttcctcattaaggcccttgaagagacagcaaagtggcaaattatgtcataagtctattcagtaaaacatacttagttcccgttttaacaggaaatagaagcaaatggaaaactaaccaattcattttatgagaataaaatcatacaacgcagataataagatcagccaacaaattataggacacttttataaacatgaagataaaagtaccatgttaaatattaggaagtgaaacccaaagatgtgctgtaaataaaaaactagaatgtaaccaagaatacaatggtagcatacgataatctgttcatgtaattattagtatgtgacaaagggaaaaaatatactgatctcacaaggtaccaataaactcccacattaattaaaaagcaataccttagcctaccaaggctagaaccagtttaactctgataaatgttattgcatctattaagagtgccttctactataagtaacagacaacttagctaattgagtctaaaataatgaagacatttgctcagtccacataattggaaatctgtagggcagtattcctacaaggatgatagagagttcccattgctgcacatgtcgccagcatttggtaccattagcgttctgaactttgatcattcgagcaggtgtgtagtgcctccacattcgttattgtagaactaggcctatagcagcaaggagaatctgtgagaatgtaacacaaggattaggctttttttcccccaaatgactagttgactgtcccaacatgggcttttcccattggtttgaaaagccacttttactgtatgcaaagaaacaataaattcaattttcttcttcttaactttgattctgttttcttgaccgatttctctattcttgcaataatcccgctttctgcagtcttacaagatcattttatattttacaaggcaagtccctctgtaaatttattcctttctcagattttctgatgtattattttttgatacattttgtagtcagcttgtcaaattccaattaaaaatcttgttgacgtgttgtttgggaatgcattgaatttatgtataaatgtataataaagcaattaaaaacaattcagtagatttttatttactaatagaaaaaatctctaagatctattattaagtaaaaaaagaaacatgatatttatgaaatacaaacacacttaatatccactgaatatttctatatgtataaatttattaaataaatgaggaaatgactaaaaggatactcattaaagtattaactatgtgaaattgggatggtaacaggtcaatatgacttttcacttgtatgaattattctaatttttaatcatgacaatacattcatgtattttttataaatataaataaactcaagaaatcttttttagttctctaaagtaacactccttagggcagttacttaactttgcatctgcttatccatctttttgtgagcttcatcctgctttgctctttttactccactttgaacagtcaagtagactttttgctcctgaataagaagcttcattgtgattcgccaacctttacctcaatggactaagcagagataggactcagtctatgatcaactcattactgattaactcatgatcaccaaggtattgattgacaaattcattagacttttctcagttttaatagcaacattaatgataatccagtttaagggccaagtattgttctgtactgcatacattatctcatgtaatcaattcaacaatcctacagaaaagatgttattattctcattctatagagaaggaaactgaggctgctcaaaaatgttaagcatattttccaaggtcaaacaattaatcagtgggaagccagaatttaaatactgtttcagaatctgaacagatctcatgatcttagcctcattaatataatgataatcagatgtttgtgcagcgctttaaaaaaacttactttacttatttatctgtcttttcagagacaatgtcttgctctgttgcccaggccgaagtgtagtggcacaatcgtagctcactgaagcctccaaatgctgggctccagcaatcctcccatttcagccgcctgagtagctgggactatgggtgcatgccaccacacgtggctactttttaaatttttaaatagagacagggtctcactatattgcccaggttcacctcggactcctggcgtccagctatcctcccaccttggcctcctaaggcattggaattataggcatgagccaccatgctttaaaattttaattaaagtaaaatgctcataacataaaatgtatcaccttagatacttttaaagggtgcagttcagtagtgctatattcacattgtagtgaaaatagtctccagaactcttttcgtcttgcaaaatttaaaccctatacttattaacaactcactgtttctccctttcccaaaatcctacactttctgtatctataaatgtgactattctagatacctgataataagtggtcatatactatttgtttatatgtgtgatgggcttatttcagttagtgtacggtgctccagaatcctcttgcagcatgtgtcacaatttccttcttttttttagactgaataatattccatgatatgtattgaccacattttttaaaaatccattcatccgtccataggcatttgggttacttctatcttttgactactgtgagtacttttgctttggatatatacttagtagtggaattgctggatatataataattcaatttttaatttttgaggaaccaccgtactgtttttcataactcctgcatcattttacattcccaaaagcagcccacaagagatcctatttctccacatcaaaacgttatttttttctttcttctttttctttttttatcattgccatcttaatgggtgagaggtgatatgtttttgtggttttgatttgcatttcctcagtgactaatgatgttgaacaacttttcatgttcttgttgtccattgtgtatcttatttggagaaatggctattcaagttatttgcagattttataattggatgtctgttttggttgagttgtaaaagttatttatatattctgaatactagtcctttctaagatataagatttgcaaatagtttcttccattctataggttgccttttcactttcttgatagtgtcttttgagcacaatagttttaaatgttgatgaagtccaatttatctgttttcttttgttgcttatgcctttcctatcttatctaaggattcattggcaaatccaaatcataaagattaatctctacattttcttctaaggctttgctcttacatttaggtatttgatatatttgaaatattttttatatgatgtgaagttggggtacaatttcattattttgcatgtgaatatccagttgctagggcaactgggtattgttctttccacattgagtggtcctcgtaccctggttgaaaatcaattgactataaacatatgggtttatttctggacactcagttctattgcattggtctatatgtctacctttatgcaagtaccacactgttttgattacactagtttgtaatatattttcaaatcaaggaagggtgagcccccccaaatttgcccttatattttcaagattccttgagcccaggaggtggaggttgcagtgagctgagattgtgccattgcacttcagcctgggtgacagagcaagactctgttttgaaaaaggaaaaaaaaaaaagatttattttgggtatccagagtctcttgcaatttcatataaattttagtattggatttttaatttctgcaaaaccagccattggtatttgaatcaaaattgcatgaaatctatagattactctgggggaatattggcatctaaacaatattaagtcttccacttcatgaacatggaaggcctttccatttatataggtcttctttaatttagttcggcaatatttgcagttttcagtggacaactcttacatatcctttgttaaatttattgccaagtattatattctttttgatgttattataaatggaatatttattttaatttttttgaattgttcatggctagtggtctttgttttctgttcctataacagaccaccacagagtgggtaatgtataaagaaaagaagtttatttagctcacagttctggagtctgggagctccaacaatacacaaccagcatctggtgagagtgttcttgctgcaccatagcatgattgaaatctgcacactgtgtatagggcaagtacaaaagagccagaaagagctggataatgcctaaaaatatgtgagatgagaatagaaagtttgaaagatccagctgaactcaacaaaacctatcatttgaaaggcagggctagaactagaaactggaaagttatctgcatcctattcaagtgtattatagtgcctctggaataagagaatggtgccttttggtaactaaggaaaatgagaacaggaatgtaatgtattagtcagaagggcagtctaatggttaccatggagactctgtggctggactgctggggttcttgtcatagcctcagcctgctccatgttgtaaccttgggcaccttattatcctccgctacatgtaaatgataaccacacatattttgataggttgtcatgaagatgaaggacaaaaaccttatgatcatttcaattgatgctcaaaaagcatctgatgaaattcaacattcattcataataaaagctctaaaaaacctaggtatagaaggaacatacctaaacaccataaacgccatataagacaaacctacagctagtatcattctgaatgggaaaattcaaagcctttctctaaggtctagaacaagtcaaggatgcacactttcaccactttttttctttgggacagagtcccaatctcttgcctaggctggagtgcaatggcacaatctcagctcactgcaacctccgcctcccgggttcgagcaattctcctgcctcagcctcccaagtagctggagttacacgtgcccaccaccatgcctggctaaatttttgtacttttagtagagacagggttttgccatgttggccaggctggtctctaactcctgacttcaggtgatccacccctcttggctccccagagtgccaggattacaggcatgagccatagagcccaaccactttcatcgcttttattcaacattgtactagaagtcccagccagagaaattagacaagacaaagaaacaaaaggcatccagattggcagggaagaagacaaattatccttttccagaaaaagctaaatatttcaccaaaaatactattaggactgataaacaaatttggtaaagttgcaggatacaaaatgaacttacaaaaatcagcatttcttgaaaatggcttttatccaaaagacaggcaataacaaatgttggtaagacatgtagaaaaggaaactcttgtacactgttggtgcaaatgtaaactagtacaaccactatggaaaacagtttggaggttccgcaaaaaactaaaaatagagtgggataacccagtaatcccgctgctgggtaggcacccaaaagaaagggaatcagtatatcaaagggatagctgcactcccatgtttgttgcagcactatttgcaatagccaagatttgaatgcaacctgactgcccatcaacagatgaatgcatgaggcaaatatggtatatatacacaatggagtgctattcagccataaagaataatgagattctgtcatttgtcactacatggatgtaactggaggtattatgtaaagtgaaagacaaccttcacatgttctcacttattttgtgggagcttaaaattaaaacaattgaactcatggatatagaaatagaaggatggttaccagaggctaggaagggtaatgggggactgggggacaagtaggaatggttaatgggtacaaaaagtagttagaaagaatgaagaagtcctagtatttgatagcacaaaggggtgaatatagtcaataataatttaattgtacattttagaataactaaaatagtataattggattctttgtaacacaaaggatacatgcttgaggggatggatatctcatttaccaggatgtgattattatgcattgcatacctgtattaaagtagctcatgtactctataaatagatacacctactatgtaccccccaaaatttaaaaaattttaaaaatcagtagcatttccatatgccaacagcaaacaatctgaagaagaaaccaagaaagtaataccattaacaagagacacaaataagataaaataaaatacctaaaaataaatttaaccataagtgaatgatatctacaataaaactatgaaacattgatgaaagaaattgaattggatgatattatgtatttagtacaatgcctgaataaaataagcacttggcacgtgttagccattcccacaatggagaaaatgaatgcaaccccaactatggaaattgagtggaaatttcctgggaaagatctgcttttcttcctttaattctcaggtcattgataaacgttgttattgtaatttcacctcttactgtgaacatgagcatgtaaatggagagagtgccccttccaaatgactaacacctattagctcatgggaaagttgacctctcaaacatgaattaaatggccacgcagtgtatgacccagtctctttggagtgtggttggtgtggctaactgtttgcagtctgataatcactgtgtatagtgaaaaaaagtaaatacacagctaactaaataaataaattccctgattttgcaaagctgaaaactagccctataggtaacaacctgctttaaacagccagtttcccccactgctggacctgtctgcagctgacattttcatttagatcgagaatttctcaatcactttctgtcatttcctatttacttttggtggctttgtgtgtgaattactttttcttcccccttttgaagagaaggggttagcagacttattgtacacaaggaaaaaaaggaagtcactactgaccatagtgggatattcatatacatattctgcttaggtatgtttgagttcaaaggaggaaacctgagagataaaacagtttaggcttgtatgtacagcaagcttgcccccaattctcaaattgtgcccctaacacaatattgtccgaagcgtcctggtgaagcttgctcatatgtattttactttcaggaagtgattgagaaaagtttacaattgtggaaatgtggatgtctgaaatattaagctagatgctcatagtctagtcttgagtgcaaagtccactatatatgtggaaaaccagtgaggtgagaggatacttcaggaaagctagataataatggtgaactttaatataatgctatgggattagaagccagaggccattgtccaaccaactcatacaatggtaataaggatgaacaacttctgttctagctcattgtcccttgaaccaatcttgagccaggtgaaagttccaacgggttaaagaaatccaaggaccctattcattaaaaacacagaaattaagcaagaaaacttctaagttcctggtatttgaggatgtagcaaagaataagatgagatttatgcacaagaagaatgtatcttctggcggggcgcgttggctcacgcctgtagtcccagcactttgggaggccgaggcgggcggatcacgaggtcaggaaatcgagactatcctggctaacatggtgaaaccccgtctctactaaaaatacaaaaagttagctgggcgtggcggcgggcgcctgtagtcccagctactcgggagactgaggcaggagaatggcgtgaacccgggaggcgaagcttgcccgggaggcggagcttgcagtgagccgagatcgcgccactgcactccaacctgggagacagcgagactccatctcaaaaaaaaaaaaaaaaaataaaagaatgtatcttacatacatgatctaatatatcaacactttcaggagggaaatctagagggatagaaaagatcttttaaaaggagcctggtaaagctttcttaaaagttgtcctgaacatcaggaagacccagacagctctatcattagttcaaagtcaatttttgttgaggtgataagcatcccatggaattagaacttttaattttttagtgagtaattttaactcaattgtaagaagatagacggagttgtctcccaggcccttgaagagacgaaaaagttcaaagtggggaagtgaaaagatctgaggaaaattcagaaaatgaaatcgtgtgctgaatatttaaggggctcatgagcagaaggtcctcagagaagctggggcaaagctcccaatattccatcttaaccagaagagcttcttttggaacttaccaatggtctccttgctggtggcattggtgatgatctcctgacacatctattcccttttctgcgacctgcctctaagacttcgcttgggaaagttctgggccaagtggggacaatcttccttctttcctgtctggaaagctcaggtgatttctgccctccataagatgcaccagcagatcttcagcctcttttacacaagggcttgtctgatgcttggaatagggccttcctggacaaactccagactggatttcatcagcagctggaagacctggagacctgcttggtatagaggatgggaagcaagagtctgccctggaaattgagggccctacactggccataaagaggtacttccagggagtacatttcttcttgaaagagaggaaattcaggaactgtacctgggaggttgtctgagtgtaaataaaatatattaagaaaattcaggaaacccaattctcaatgactaatgtcctagctcacactctgttcagtcatttctataactgttctttttgccttcagtggtaaaataacttgaaccatttttggcatattcttatcagtaatgttaaatgtgtctgtatataactaattttagaattggaagaaatgccactggtatcttgtggttgaaactcaggttataaaatatgtatttttattaacttgtctatttatttttgatggtatttgtatttatatgctgtattgtttatataagcatatatttacattttcctcgttaatagaaatactactttaaaaaactcattaagtttattgtaagacttttctcctctttttaaagagaactttttctcaaatctgaattctgcacgcaaaatataaaaatttttgttacagtcatgctttggccttggtgacagatcttgagtatgagatgcataatccttgcccttatggaattcacattacagcaaaggacacagccattgaagaagttataatctagtatggaatttacatttggcatctgggctacacaggagaagtaaaagaggctatggcagtgaatgtcacggacagctcatttaggttgccttctaccttccccagggaagtaatatgaagtcagagacttgaaggataagtaggagtttgttaagtatcttgtggagggcaaaatttcctagggcaaaacaaaaacaaaaactgcatagagagtggccccgtagctggaaagggccaggaaaattgaaagaagtgaaaaagactggagtgggtagactggactggtaaatggtgaagtgtcatgtaatgatgctggggaaatggaaaagggcccagtgacagctttatgttaaagatgctggacttgagaggcaaggaaaattactttggcatgtaaagctgaagagtgctttaccagagcactaacaaagatatttgttagaccaaaagttctcaaaatgtggtccatatgaccataagggtccccaagacattttaagaggctccacgaggtcaaaactatttttgtaataaatcgacattacttgtctctttcaccatgtgaacaacttgcagtgatggtgcagaaacaatggtgggtaaaactgctggtgcctgagtgttgatcaaggcagtggcatcaaaaggcggtagtaattattacatttttcactatgatgtacttgaattcaaacaaaataccagtttcttttaagaatgcccttcagaacacagtaaaaattattaatttttcaacatcttgactttgagtacaatcgttttaatattctatgtgatagtctttttaatattctgcatgactgtgcttatggctcatactgatagaaaatgattgtgtcaaggaaatgcactcatgcgattgagttgtgaactgaagtagccactctttagcagaataacatttttagtggaaagaatgacagacagacaaacagtagttattgagacttgggcatttgacagtttttcaaaatatttatcaagtgaacctgtcacttcaagggcaacaatcaccagtatttgtcaccagtgataacatttgagatcttagtagaaaattggaattttggaaaaatttgtatccgtcattacgaggttgataacttccttattcttcaaacttttgtggtgataatagtggtgatataggccattgaatcgttcgataatatagattgaaatttaaatacacatttgtaacatccgcaaaactcagtgaaccaatatttcctaaataacgaattcatatattataaaatttagcatgggcaaaagagatccattcagtgtatggcttattcataaacttctatgtaacataatttgaaaactcatttttttttggtttaaattccacattacaactaatccttatggaactaccacttatccaactctgaaatgttacatgatgcattatagcatcaagtcttccttccatttctaagatacacttcttaataatgattaattaatttattaatgtgattttaaatgttgtcacagtggaaaatatatggaactggggaagataagttagctttgaatcatagttctgctatataatagatattcttgtacagagtaggtgctcaataaatgagagtcattattacttactggcaggctgtggagaataagacattgtttaagagcttgataggattggtgaggatttaaagtgcttcctgtaaagtgcttagcacagtccttgttgcagtgtgaacattcaataaacattagcttttattatttatattagtggattttgaacatcttttcattgactttaaggagtgaggctaacctctttttaattcctatgtttgatgaatgtttacctctgtatgtagctttgcttcaatatattttaagaatagtgctttaattccattactaactaaactacttattttactttttcttcctgacttaactgaatgtgtcagtatgattttaaatatctaaatgttcgctttaaaaatcattttaaaaagaataattccaggcattgtgatctaattatacaacttagagtgttttttctctggaggaatttgatagttttctgtaatctaatacagggtaatttttgtgaatgatttataaatatatgaaaaatatattttttattctaagttgtaacttagtgccccagaatcttagccaataatgtatctttttcaattatatttgaaattattcttgttatttttctatgctatattttaaatcacaatgctaaaaatgtcaatattaaaatgacatttttgtttgtttctctatatttgctaacttttttctgtatattgtatattaaatttcagttctatgtcttttataatttggttataaatcctatttgtttcctatgtatattgatactctttctcaaatgttcattgaattcccacaagtatcaatatttatattaatcaatatctcattgatattaatattgccacctctatttttcctttgttgtattgcttttctctttcttgcccatcttcttcttttactgttttagtatttttaattttaggcttttctcatatgtagagtaataacggggtttggttttaagccaatcaagacttttttcttttaatagggaactctaagcagcttatatttattatcttaactattatgtgtttggttcttcactttattgctttatgctttacttcttgcattacttttatatgtttttaacatttatacttccttcaattatttaattattattaatttcagacaatatatttttaaaagaaatttaaattttctcttatttttgaactaaaaattgcatagtactttaaaataacattttaaaagtatttcagaacttttaactgattttattatttactgccagctcttactgatactgttgcttttggtcaacatagtatgtataagagataggagataagtagatccgtatgcatgtgaatttatgttcataaataaatatatgggaagttccacgaagttgatgaagagaaattcattcctgattttaggaaataaaagcatattaatttaaatgctcttagaaggaatgcatttggatgcaataagctagattagcgtcacatattccaaatatattcctgcatgtttcaggagtcatgtaatcaatagaacagtgatcaacttaaacaattttcattttaagaagaaacatgctatcaatataaagtgatgagtttgatattcttgtctagcctgcaaactggctctgaagacagttctcatcctggaattgaaaactttttaaaatagtggtaatactgttgccatcattgattgttatagcttctgaagtgtttttcaagacatatttgaaactgtagcaaggtacatttataatgaaataaacaactgaaacttttacctgagcaccatgtagactcttcctttactatgtctctaccccaaccttttaccaagaaggcagatgaattctcttgggtctgagtgtagcacataagcaccaggggttccctcattacaccatgctttccatctatttctgtaggtttttaatggcctttctttggtgatcctgatccaatgttggacaggatcaaactaaaacaatggaagaataaagattttagggaactctttttctgtgctctagaccctcagctttggagtgttgctttgactagtgctgtcactcttaaccaggtatgtacgcttgatgttatactgccatctactggctatacgtcaaatactggcttagagacgacatactgataactttaccatggtcattagctgggaataattcaggaaattagaatgtaaagaaaggacagtttgatgtgctgcctaagtaaaaacaaagaaacaaatgcataaatgaagcccacacaaaacctctaattcataatagtgatcccagaaatgtgaaatttgtttttcgatcactgtattcttttttactcccaagataatcttgttatttcccatttttgttaagtaatttaaaaaagaaaagggaacatacattcacacaggacactaatcagaacaacaaggctatatttttgtttgtgttgtgttttcaatgaaacaaaaaattgaacctcagggttgttaaaccctgacattatgttcaaattaatgttccaggagggcccaattttgtttctaggggttcgttttctcagatgcttttaaaaatgggtagaaagtggtgccatgagaaacaatggcagagtaaaaatctctaaaaaatttgccccttcataaaagtaaagaaaaaatgagcaaaatttgtcagaataaatctttttacaatattatgagttatcccaaggcatgcaacaacccaggagcatttatttgaggaaaacagctgtaagtgtaagtatagccagatttgtggcatattaacttgaattaatcccatcacccattatcaagttcagtggtagccttaaaaagcaatgggcttccttcctggtaccactgggaatagaaaaaatctggagtgccttcatagcttcattcctaaagattgtcattatttgacttcgaaataccctagtagaaagacttatctttatttaagctgtctgggagctcactcaaagctaaaagactctccctgaggagtgttgactaaagacatttacaggccagtgttttgatatagttgctacctgaggtgattaattacggttgtagtaaataatgaccaactgaaaatcttaaaaggaaaaacagagatgagatgtctataagggctttgacaaattctagcatacttttgggaatctagaagggcattgtacatgtgtaagtttgtgcacatgttcaggaaagacccagtctttcacttctggctgacttttatcataagcagaaactgaaggccaaggcagggttgaaaactgcctggctaagtattaaacatgcacttcaacatgcacacagagcttcttggctaaaactgagagatttatttgttccagatacttaaggaaatctctgttcagtcattagctggccactaagctaactgattagagacttcagtgggcacatgtgctaacgaatacagactttacagaattagtgcagaaaagacagcaagtaaacaaataacaacccacaacaagcagcaacaacaacctcttgggggatggggaactaatttatacagttgctgcagtttattattaaaatgtccacttttcaacaaaaaaatataagaatgcaaagaaactatgtcttatacacaggtggaaaagtcatgaatagaaacttcccccaaaagcccagatattaaatttattagacaaaaacttaaaccagctgtattaaataagttcaaacacctaaaggaagccatttctaattaattagaggaatacaggagaacaacatcagatcaaagaataccaataaagagaaagaaattatacagaggaactgaatagaaatttgctagctaaaacgtacaaaaattgaaaaagaaaacttcacttgaagggtctaacagaagatttgagtagacagaagactcaatgagcttgaagacagatcaattgaaattatgcagctgaggaccacagagcaaaaaaatgaatgaaggaaaatatatagagtttagaggacttgtggaacaccatcaagcatactaacatatatatataatgagaactacaggaggaaaagagagagaaaaggggcagcaaaaatatttgaagaagtgtggccccaaatttagcaagtttggtgaaagatatgagtctacacatcaaaaaacctcaacacacttcaagtagaataaagacaaatagatcacacacaggataatcaaatgattgaaagccaaaaacatagagaaaatcttgaaagccggaggagagaagtgactctcacatacaaaggatcctcaataacattaacagcaggtttcctattagaaaacacagaggccagagggtagtgggatggcatatataaaattctgaaaggaaaaataaccgaagaattctatgtctagcaaaactattcttcaaaaatataagagagataaaaacatttccagataaacaaaagctgactgagtccatcattagtagatctgtcctacaagaaatgctaacgagccttctaggctaaaataaaaggacactagacagtaacttgaaggcatataaagaactttggtaaaggtaggtaaatataaataatattattgtactcccctttttatttcctatatgatttaaaagtcaaatgcataaaacaataattactaatctatgtgaatgggcaaacaatgtttaaagacaagaggtcggaggggagacagagcagcataggagtcaagattttgtacgctgttaaatctaagctggtatcaattcaaactagattgttgtaaatatagaatgttaattgtaacttccatggtaaccactaagaaaatatttaaaaaatataaacgaatcagagtgtgagggaaactgggcagtatgctaaaaaaattaaacacacaagaaggcaaaaacatataagctgactccccattgtgaatctattgtgggaaacacattatattcttaaactttaggaagcatacttttcaccttgatccacgccgtgttgaaaaacagaggggtgattgtgggagactggaattcagacaatcacaatgatgactgtgatgatgggggatgagaagtcttctatatagcacttattagacttaattctctctgtcctaacacacacgtgagcacgcatgcacacatgcacacacacacacacacacacacacatgctttttacaaaatatgacaacctgtatcaatacaggctgcaaggtaattattgcgtcaatactattatatctcacaaagtacaagtaaagattaaacaatcaggcctcagaaaaggtgagaactaggtaaatctcatcgttctcagaatattctcattagcattatttagtttctaactctaaggctttaggttttttgagtcaaattcttagaataattttctgatttacttgtactggttttgttagccataggcagtaacaacatagctggcaggccccattgccatggctggagagctgttcttacagaagtgaaaacaaaagatatggtctactacattccaaacctttccttgttggtacctacactcctctttctattgatactatttcaaagatgctcaattgttcaacaatatgctgccttcaaacgactcagtttagctttagaacataactaggctgaaagtgcaaggatggagaaaattatttcacacaattgatagccaaaagagagctggggtaaatatactagacaaaatagactttaggtaaaaaaaaaactataacaagaaggtcattatataatgttaaagggataatttcatcaagagaatacaacaattataaatatatatgtactcaacatcagaacaccaaaatatacaaagcaaatattaacagatctgaatggagaaataggcagcaatatgatcataataggagacttcaataccccattttcaacaaaggatggatcattttgaatggtttacagtaaaccaatgaagaagcaaatttaaaagattgaaatcatatcaagtatcttttctgactataataaaaaataaaaataaattaacaggaggaaaattggaaaatttacaaattgtatatattatatatattaaattatatatattatcatatataatataatgtattatatatgataatatatatacacaacatactcctgaataaccaagaggttaaaaaagaagtcaagaagtattttgaagcaaaaacagaaacacgacattgcaaaatttaaggaatgcagcaaaagcagttctaagagggaggtttctagtgatacatgtgtacataagaaggaaagaaagatttcagataaaccacttttcacctcaagtaactagaaaaagaaaacaaagcccaatgttagcagaagaaaggaaatattaaacagagcagaatcaaatgagagaataaaaagaaaaattttaaaaaatcaacaaaactaagagtggtttttgaaaagataaacaaaattgacaaatgtgtagctagactaactgaaaaaaaggtggggggtgggggagagagagaagattcaactaaaattataaataaaaaagagacataacaactgatattttagaaatatgaaggatcataagaggctactatgaacaattatataccaacaagttgaataacatagaagaaatacagaaattcttagaagcatactgtctaccaagactgaatcatgagaaatagaaaatatgaacatggcaataatgagtatggtgtcataagctttaccttaaaaaaatttctcttgaatatatttggataagtggcactaatctattgtattgcttccaaataacattcagattaatgcatttttatttcataaattcaggaataattttttattcactaacttcttggtcattcttatcaatttatatatgaacataaattaacacgcacgtctaccaatatcatatctgttacacaaactatgctgactaaaaatgtgacagtcctagttagaactggcagtgaagagtaaaatcagttaaaagtattatgaaaaattttaaataaaaaattaagagaaaatttaaatttcttttaaaaaaggaattgttttaaaattaataataattggagaattgaatgcagttaaaacatcaaaaacatatataagtaacataaaaagtaaagcagaaaccaaagttgagaactgagcacataatggtgaaaataataaatataaattgcttaagcttctgtattaaaacaaaaagtattgattggaatagtgtcaataggattggtataaattcttttttgaatgtctgatagaattcagctgttaatgtgtgcggtcctggactttttttgttggcaatttttagattaccacttcaatcttactgcttgttattggtctgttcagggttgctatatcttcctcgtttaatctaggagggttgtgtatttccaggaatttatcgatttcctatgttttctagtttatgcacataaaggtgttcatagtagccttgaataatcttttgtatttctgtggaatcagtagccatatctcacatttcatttctaattgagcttatttgggtgttctctcttcttttcttggttaatctaactaatggtccataaattttatttatcttttcgaagaactagccttttgtttcatttatctattgtatttttttgtttcaatttcatttagttctcctctggtctttgttatttcttttcttctgctgggtttgggtttggattgttcttgtttctccagttccatgaggtgtgaccttagattgtctatttgtgctctttcagacattttgatgtaggcatttaatgctacgaactttcctcttagcaccacttttgctgtatcccggaagttttgataggttgtgtcactattatcattcagttcaaaaaatttttaaatttccatcttgatttcatggttgtcccaatgataatacaggagcaggttatttaatttgcatgtatttgcatggttttgagggtaccttttgctgttgatttctaattttattccactatggtccgatagagtacttgatgtaatctcaattttcttaaatttactgagacttgttttatgacttatcatatggtctatcttggagaatgttccatgtgctgatgaaaagaatgtatattctgcagttgttggatagcattctatcctgtattctataaatatctgttaagtccatttattctaggctatagtttaagtccattttttctttgttgactttctgtcttggtgacctgtcttgtgctgtcagtggagtattaaagtcccccactattattgtgttgtcatttatctcatttcttaggtctagtagtaattgttttataaatttgggaactctagttttaggtgcatatatatttaggattctgatattttcctgttggactagtctttttaccattatataatttccctttttgtcttttttatctgctgttgctttaaagcttgttttgtgtgatgtaagaatagctacttctgctcacttttggtgtctatttgcacggaatatctttttccacccctttacctgaagtttatgtgagtccttatgtgttaggtgaatctcctgaagacagcagaaacttgattggtgaattcctatccattttgccattctaatattagtactgaggtgtaagggactattctattcatcagcctgtttgtcgcttaaatacctttttttttcattgtgttactgttatatagttcctgtgagatttatgctttaaggaggttttagcttggtgtttcaaggatttgtttcaagatttagagctctttttagcagatcttgtagtgctggcttagtagtggtgaattctctcagcatttgtttatgtggaaaagactatctttccttcattgatgaagtttagttttggtggatacaaaattcttggctgatagttgttttttttttaaggaggcttaaaatatgaccccaatcccttctagcttgtagagtttctgctgggaaatctgtcgttactctcataggtttcttctttacaggttacttgatgcttttgcctcacagctcttaagcttctttcttcatcttgactttagataacctggtgactatgagcctagatgatgatctttttgagatgaatttgtcaggtgttctttgagcttcttgtatttggatgtctaggtttctaccaaggtcagggaagttttcctcaactgtattttcaaatatgttttccaaacttttagatttctcttcttcctcaagaacaccaattattctaaggtttggtcatttaacataataccaaacttcttggaaactttgttcttttttaaaattcttatttatttgccttagttggattgggttacttcaaaaaccttgtcttagagctctgaagttctttctgttgcttgttcaattctattgctaaaactgcatttctctaagtgtgtccttgatttccagaagttgtgattgttttttatttatgctatttccctgaagattttcctttcatattccatatcatattttttatttcaaggagcagaatactatttttggatgtcttaacacaggaaaaggaaatagaactctgtgtgcccagttcctttacctgtaaaattaagataaccatagtcctacctcgtaaaattgtggcaaggattaattgtttaatttatataacacactcagaatgattcctggcacttaactaagggtacttaaacgttagctctcctatttgaaactgattggaggattattccctaatgtgctagttctgcaggaaagtgagttaatttcaagaaaactggccagggaacattttaatgccagctcaactactcacaatggagaggcagaaatagccattcacttggtgactgaagcaagcatgttgcagcaaagatcccagggtatagacagaagcactgctacctggcacacacacaccagctgtctacaatggcacactttactttcctggtttcttggttctgtctaccatttgaggagctaaaagctttcaccagaataacacaggcatctttcaggaagccagaaaaaggatcctgtgctctgtgaagataagctgcactctcctcaggcacgtgccaggcaagagaggaatccccgctccattcttcaaatccaatttgtcaactcacatttagttcccttttcacttgttgcatcattcttattgttatttttgcaccatccggttcactgtacagtccctgtgcagtcattgtacagtccctgtttatctatgatgaaataaaactgcatttagttgtaagttttaatggtatgaagggtttttggtttaactttaaagaagtgccagaaactgcttcagagacaggaagctcctgcagaaaaccgataatagacatgttcacctgtttgtggagggaatggagctggtgcttattcagcagctgctgtgtgttgtctgtgtattctcttcttaactctaggcctggctgcatttatgcctgagagtggttgtgaggattaaatacgtccagctcagacaagtgcttgataccgaaagagaaaagtaaacccaggctggaggctcactgaagtctgtattggatagagccaatgtggagtttctcgcagagggagtccaggtagcacctggtagaagatgttgggtgggcagctgtaggggccaggggaaatcttgccctttgacctctgaaggttccgtgaaaatcaattgacaaaaggcagatagattaataggtgaaaaggcatacaaattaattttatcatagttttatgtgtcatgggagccttcagattgaagggccaaagacaccatttctatgcttaggttaatgaagaattggacagctatgtagaaaaatgactggataaaaagggcatgatctaatgctaatagactgagtgaggaagcctagcaaggcctgtctgtctagattcttctgggcttttttgtgcaacattccttactctgggaatggggcagggccctctctgaatggagttataatctacttttagataaaacaggtaaaataatttctttatggccagtttttatgcagaaagacaaggagaaggttgaattaatatgattaggttttatggttgtcattggggaaaggatttctggtttctatggcctgccttgggaagagagattctagagaataagggtcaaagagagaggggcaggaggaagtcagagaaagttttgcttctgaggctgcttctgtggccgtcattttggggtattgttttctgagcctcagcacagcccttgtgtatccctgggccatcaatccattgatgagagcattctaactgtggctggcggtgaagagtgtaggaccctctggttgtgtttgcataaaggagaagggtcattattgtgagaaagaaaaagtagtgtctttttctcacccattacaaggttcatggctaatacccctataataaaagaagattaacaagagaaaaccataactaattttagaaacaattttttttatgagagacaagacgatttagaaatgaagatccaaagacccagggaaactgtctatttttacgcttaggtttattgaaaaatggacagtcatgtaaaagcatattggacaaaaaggggatatgaagtattgttaataaactgaggggggacttagcaaggcctacttgttcagattattcttggtgtctctgtgtctttattcctttcctccagaagcagggaaggacacctgtcacatgggggtcttgcgacctactttcaggggagataggacaaagcattattttatggccaactttcacacagaaaggttagacaaggtcagagaatgaccttgagtctgcagttttctgaattttcaaggtgccattattttggggtagcatgtcgggaaccctgatattaacatgagttaggcagagctcccccgcatcccccctgcccagtgaagtggcctagttcctcctgggttccaaggtgacagaagagaaactgaggaatggatctagtcaaagacttttgactatgacaagatatccaggatgtgggaaaaggaaaaggaacagagaaatgtctgacagcagtggcacatagatggcatgctctgcctcttcacaccaggtttgaggtctgaaggtggattccctacccaacaagctgttggcttgtggttatagagagagcccacagtgggaagaagcagcttcagggactgaatgagggtgagcaggagacagcatgcggaagacagagaaacagatttttttttcctttccctgaacttaggctttttctttgtggttcccaagtttcacagaaactttttaggttgctgagcaaaattttccaacgtaattaggacttggtgagattacccctcattttattattgtagtgggtattgtttttaaactaagctgctgtaaatatgttgggtgtattttcttcttaaccctgggcctggcttaattcaccccaaagaacagttgtgacgattagatacatccagctcagaaaagtacctggtatccaaagggaaaagtaaatccaggctggaggctgactggagtctgtatcagatagggccaatgtggagtttctagtcatggacatcctggcaacgaatggtgggagaaattacatgggcagccctagcatgtccccgggacatcaacttattgatgggaagctttcaactgtggctggggcacaaagtatgtaaaccctctgttgtgtttgtgtctatcaggagggttgttattagcaggagttaggcaaggaccccagcacagtggcctattatccagctggatcctgaggtgaccaggagggaaactgaagaatgagtctagtcaaaggatgtgaaaagggcaaaaggaacagagaaatgtctgaaaccagtggcacatgctctgccttctcacctcaggtcagaggcctgaaggtggattctctaccccatcagctgttggcttgttgttatagaggaaccccagcctgcagaggcagtttcaggcacagagtgagggtgagaaggagcccacaagtggaagacaagaagacagattcttctctttcctttcccccgaacttaggctttttctttgtgattcccaagttttacaggaactctgtatgttaagcaaaattttatagttaaattaagactttgggtgagattactcctcatttttttattgtggagtaatcacaataaatctcattttgggtgagattactcttcattttttaaatacagtttttgaaccaagctcttcctccttttttgtgtcctcattatctcccatccccacccttttccaacagactttcctccaaatgccgtctggtgctacaccacagtcactatgcatggtcaggaaaatgcacatttgttttcctgtggtttgaaaaggacaaccaataaaaaagagattaatattattataaactcataatagtcaccccaattaaaaacccagaaagatacttgtaaatgtccataccagcaggtctcagatgttttcgtttcagcgctcactgatactcataaattatgggcatcccctcaaagagattgtagttgtgtttttctatttattgatattcatcataagttaaaattaagaaaatgtttatgtatccacttaaaaagaacaaaaccaagcccattacatattaacataaaaacagagtcttatagaaaataactacatgctttaatacaacaaattaatgggaaaagtagcaatgttttgacgttttcaaatctttttaatgtctggctgaatagaagatagatggattcttgtaacttctctgcattcagtctcttgtgatctgttgttttgtttgacatctgtgaataaaatccagtctcagacatgtagttggaaaagaggggaacttgatgactcctgaaagagtcctagcagtcttcaaatcacactttgagaacaactgatagatgtgaaaggatacttactgcctatagtgagtttgagtttcatcttttgcctattttccaattgtctttttaaattataatttagaaaaccgagaaatatgggaaaacattatactcttgtggtttatatttttcaggattatccactaagaagttaagtacaatatacctgccagtttatgtttttgtttattaactttcttttattgtgaaatataacaatcatacacaaaagtgcataaaacataagagtaaattttaaggaataattatgcaaatactcatgtaaccattaactgataaaaacaaccagattttgcaatatactggaacctctgccaccattaccatcccatgggcccattcttggacatatctctatctctgctcactagaagtaaccactattctgagttttatggcaaacacttcttttctttctaattttatcctaaaccatgtggtccagttttgcctgtttttaaactttttataaatagaatatgtgttctttcagattcagcttcttttactcaccattatgtttgtgaggctcatctctgtgtaaacagttgtagttcttgatttttattgttgcttatgatcttattatatgcatggactgcaatatatttatgaatacaacttttacaggatattttaagagaattgctttggctattcgaggtcttctgttgttccatacaaattttaggattatttttcctatttttgtgaagaacatcactgagattttgatagggattatgttgaatctgtaaatatacaacatatgtgtagtatggccactttaaaaacctcagttctttcaatgtgtgaacacaggattactttccattgatttgtgtattcttcaatttcttgcattaatgttttatagtttttagtgtataggtctatctcctctttggtaaaatttattcctaagtatttttaatgctattataaattagattattttcttgaattttttcagctaagttatttgtgtatataaatgcaagtgattttcattacattgattttgtctcctacaacttaaccaaatttatttcttagttctaaccgttttggtggagtccttggcgttttctacatacagaatcatgtcatctacaattagagataacttcttcctttcccctttggatgccttttatttcttcttcttcttcttcttcttcctcttcttcttcttcttcttcttcttcttcttcttcttcttcttcttcttcgtcttcgtcttcgtcttcttcttcctcttcctcttcctctttctcttcttcttcttcttcttcttcttcttcttcttcttcttcttcttcttcttcttcttcttcttcttcttcttcttcttcttcttcttcttcttcctttttttttgatctgatttctctggtaggacttctagtactacattgaataaaggtagcgtgagtgaacttccttgctttgtactgatcttagacaaaaagctttatttttccccccattgattttgatgttagctctgactttctcacaaatggcctttattatgttgaggatgtttactccaatacctaagctattaggagtttttgtctaaaaaggatgtttaattttgttgaatcctttttctgcttcaattgaaataatcatgtggtttttaatcttgtcttttctataaaattttcaagaccacttccaaatatgaattcaattacactaaaccaaattcacgaatcatttcagaagatctaaacatgaaactggttttgcatttcagattactgatgttgaatcatgcttaaaaccatttaaaatgaaatttctacagaatgtaaatggtcagaatatttaagagccaagttactagctacttttttgcaaatcagatgtattcattgaaaaattgcttcccttaaatatttaacatctgaagatgcttagtttaaattttcgtatctccatttcagagttgaaattaagatgtgaataaacccctattttaaataatatccctagatcatgtaagaattgatactttaatccagtgatgtctccatttctaattgcttaacatttttcgaatttattttcacatttgggaagtgtattcgtatctcttactagcattttacatttatcaaacatactctcaaagttactttcatttgttgtaaacaaaagggtaggtcttctatgaagccagctgctttatataaagacttttctttttaaataaagctttcttattttttcctacttggttcaaaatatcccaccaaattaatttgcataaacatgtgcagtctctttgtgccaagatgctttagatttcagcacaatgtactatgtcatttaatattatatcattaatatttgataaacatctttagtttgtgtgtgaagtgccataattttgtttgttcttgatccccattgaatgtccgttatgtttttaatacagtttttaggacagatataaggatattctattgctcaaagctcaaaaatgtattaatcctttgtacaatactaaaaaagagtatcatatttcaagtcaccaaatcaacattattacaaatcaaatcagaattattagttgagtaggcacaaatttagcataacaatttttgagggaaataatggcttgttcaccatttatctatctgccatctttgcttcattttcatatccttggccaagagcatttttatgtcaatatattgaaaaaatttcataaggcaagccatacccagttttttattttatttcaataaaaagtcaaccaacctttctttccatggttttgtcattattctcaatgagagcatacttaaacgcatctgtttatcataggcaacatctacatatgtttacaattcaaaagaaagaattttttcttccttttaagtttatttttaaattgacaaaacagtttatatttaccaggtataacatgttgttttgaaatatatatgttatggaatggacaaattgagtgcattaccataagcattacctcacatacttatggttttttgtagtaagaacgcttaaaaagtactttcttggcaattttcaagaatataatacattgttactaatgactaactgcagtcaccatattgttcaatagatcttttggacttattcctcctatctaactgaaattatgtatcctttgaccaacatcttcccaatactacactcctccagcccctggtaaccaccactccactctctactactatgagtttaactttttaagattccatatgtaggtgagattatgcactgtctttctatgccttgcttatatcagttaacatagtgtcatccagattcattcatgttgtctcaaatgacaaaatttccttcctttttaaaatggcaaatagtataccattttgtacatactattcatacattctctttatctattaatctcttcattaacatttaggttgtttccatatcttggctattgtgaatagtattccaatgaacatgggagtgcagatatctctttgacatactgatttcatttcctttggatatattctcacttgtgggattgttgcatcatatggttgttctatttctaatttttataaaagcatcaaaagtaacaaacaattatgaacaaatgtgatagaaaatttgccaagactgtacactggaaactgtaaaatgtctctcagagaaaacagagaagacataaacaaatggggagagataccatgttaaaggattaaaagactcagtattgttaagatatcaattgtaatcaaattgatctgtagactcaatgcaataccaatcaaaattccaccaggctttttgtatagaaatttaaaaatggattctaatatttatatgaaaatgtgtagaacaaaaaacaaccaaaataacatttaaaagaacacaaaatgttggaggatttatactatctgacttcaggagtaaagtaatcaaggcagtaaagcattagaataaaaaaaacacaaatacatcaatggaacagacaggagtatgcacaaatagagccacgcatatactgttgattgtttttttcaacaaaatcacaaagggtattcaaccaaaaagtttgcagatgacatgattgtatatttagaaaaccccattgtctcagcccaaatctccttaagctgatacacagcttcagcaaagtctcaggattcaaaatcaatgtgcaaaaatcacaagcattctgtacaccaacaacagacagagagccaaatcatgagtgaactcccattcacaattgctacaaagagaataagatacccaggaatacaacttacaagggatgtgaaggacctcctcaagcagaactacaaaccactgctcaaggaaataagagaggatacaaatacatggataaacattccatgctcatggataggaagaatcaatattgtcaaaatggccatatttccccaagtaatttatagattcaatgctatctccatcaagctaccattgagtttcttcatatggaactaaaaaagagcccgcatagccaagacaatcctaagcaaaaagaacaaagctggaggcatcacactacctgacttcaaactacactacaaggctacagtaaccaaaacagcatggtaccaaaacagatatatagaccaatggaacagaacagaggcctcagaaataactccatacatttataaccatctgatctttgagaaacctgacaaaaacaagaaatggggaagggattcccaattgaataaatggggttgggaaaactggctagccatatgcagaaagatgaaactggatcccttccttacaccttatacaaaaattaactcaagatggattaaagactgaaacatatgacctaaaaccataaaaaccctagaagaaaacctaggcattaccattcaggacataggcatgagcaaggacttcatgactaaaacaccaaaagtaatggcaacaaaagccaaaatagacaaatggaatctaattaaactaaagagcctctgcacagcaaaagaaactatcatgagagtgaacaggcaacctacagaatgggataaaatttttgtagtctatccatctgacaaagggctaatattcagaatctacaaagaactaaaacaaattcacaagaaaaaacaaacaaccccatcaagaagtgggcaaaggatatgaacagacacttctcaaaagaagacaattatgcagccaacaaacatatgaaaaaaagctcatcatcactggtgatggtgcagagaaatgcaaatcaaaaccacagtaaccacaatgagataccatctcatgccagttagaatggtgatcattaaaaagtcaggaaacaacagatgctagagaggatgtggagaaataggaatgcttttaccttgttggtgggactgtaaattagttcaaccattgtggaagacagtgtggcatttcctcaaggatctagaattagaaataccatttgacccagcaatcgcattactgggtatatacccaaaggattataaatcattctactacaaagacacatgtacacgtatgtttattgcagcactgttcacaatagcaaagacttggaaccaagccaaatgcccatcaatgatagactggataaagaaaatgtggcacgtatacaccatcgaatactatgcagccatgaaaaaggatgagttcatgttctttgcagggacatggatgaagctggaaaccatcattttcagcaaactaacataagaacataaaaccaaacactgcatgttctcactcataagtgggagttgaacagtgagaacacatggacacagagaggggaacatcacacactggcgcctgtcagggggttgggggctaggggagggatagcattaggagaaatacctaatgtagatgatgggttgatgggtgcagcaaaccaccatggcatgtgtatagctatgtaacaaacctgcatgttctgcacatgtaccccagaacttaaaggataataaaaaaaacaaaaaaaaaataactgaagaaacaaatggtgttggaagagataggcatccctatgcaaagcaataaatcttgacacacgcgtcataccatatgaaaaaattaactcacaatattggtaacaaaactaagtataaaacctaaaaccgtacaattttgaggctattaaaaatttttttacttagaaacactaaaagcacaatctgtgaaaaaattggtaaatttcacttaatcaaaatttaaaaacttatttttaaaaggatagttttattaaaatgaaaagggaaggtagagtctgggaaaactttgtaaaacatttatctaacaaagtacttgtaactaaaaccatagaatgcttataactcaacaaagaaggcacaaaaatggacaaaaatatttcaacagacattttaccaaataagatacccaaatgacaaacaagaacatcacaaaatgcttaacatcatggataattaggaaaattaaaattaaaatcacagtgagataccactacccaccaattagaatgactggactgactaaaatttagaagactgaccatatcaagtattggcaaggttgtggagtgactggaacacttacatcactaatggagataaaaatggggcagccacttcggaaaagtgtttggaagtttctgaaatactcctactgtgaaacaaagacattccacctatacgttttactgcagaaatatgcccatgcaaagacttgtacaagaaagtttacagcaactttatttgtgaaaccaaaaattgtaaacaactaatccataaaatatccataaaaaagtaaagagaaaagcaaattgtggtatattcatacaatggaatatgatatacccataaaatgaatgaactattgatgaacacaataacatggatgaatcttacttaggttgaatgaaggaagccagacaaaagagtccctattgtattgctccacttatgtatctgttttagtcacttggcatgtataacaaaataaacagtgtggcctaaataacagacatttatttctcacagttctggaggctggggaagtccaggatgaaggtgttggccaatgtagtttctagtgagggctctctttctggcttgcggacagccaccttctcactgtgtcttctcttggcagagaaaaagctccaatgtctcttcctcttcttataaaggcatgaatcccatcctccaccctcatggcctcatctaaactaattaccacccaaaggcataccacctaataccaacacattaggcggcaggatttgaacaaatgaattttggggagacactcagcccataactatagcattctatgaaatggaagctaatctacaatgacagaaatcagatcagtggtggcctaaagatggggagggaaaagttagggaagcatttaaaaagagccctggagaatttttaaggatggtaaatattttctttttttgtttatagtgatagttacatgggcatatccatatgttaaaatatctaattgcatgattttcaaatatgcagtttatggtatgtcatttttttaatcaattaaagctggaaaatggaaaagggaacatactgcagttatgcagtgcctttgctcaagctgtttcctctgcaggaatgcagttctgctctatgtctacctggaaattgctcctcacccctgtgaaaagcccacatcctggacaaagttcttcactgtcagtagtgagctcctggagcctgttccacaggctgtttttgactcaccaattatcctgcattcaaattaatatgcatgtgtcctgtcttctcccaagagactgagaacaccttcaagttgagtatattacctgatttatcacagagtagatatcagcagttgattttgatggctgtcacttggtcctcaccatgacagtgccacagttgccaaattagagtgcatgagagaccctctggctctccttgcaccaaatttgcctattggtagattccacaggggaataggaattattagcaagaacaatatgttactgtgacttaaattattacctggtaatttaggcataattgtctgaaacacataccttttagaagctaaagattactcagagaacagctaacaaattaaggaaaaaggatctcaggctgcaatgcctgattcagggaatgggttgtctgtataaatatggctacatagtatctgacagctccttggagagtggataaatgagtggtcagatagcttattcatcacactaagatacatacatatttatgacatgctgtaagattgaagttggaaagcaggaagtcccagagaaaagcggcaggatccagagaccagaggcatggtaggatctgctaggatggagagtatggaggggctgtctgctccctttccacttttttgtctcctcctccactcttaggaacactctgggatcatagtataactttgtggtgctgacctgggactgtatatgaaaccacgttttctctgtgtccagttactgaggcagcaacacacttcagatcatgaggaactttaggttcttctgcattttatttagtactggggctttggttccatcttttagttttgtgtgccgttaggatcttcttactgtcatgtaaatacactcagtggagtccatatttaccaacatttgaaaaaatctgaaatatcagtctggtaaaggaaccctaggttcagtccaaaaaataaatggactcttatattctctttctctctctctgcttttctaaattaattatcagaatacagagagtttttgaataggaagtctcaggagggattgggaaatcatcagcatagagcagaatggtcaggatgagggatacagtgagaactaagacttcaatccattgttcacagactatctacctgggtgtggtacatggctccagaataaagttttagaccacagatgcagaggctgtggattggtctattaaggcacccaaagagaacaggccccaaggccttgttcatcagcctctttcccagctcaggtgtctctagaccaagcctctcctttgtcccagggccaacatggagaggaatgctgagcctctgaaagtctccagagagtactcaacatgtcctcaggaagtcctattacatggagcacatgcaatcctgaagatctgagattccttgcctttcttcagcagaggactagtgtctgaaatatttttctaaaaagtgcggaattccattctgtattttagtttctcagagaagagttagaaaaaaattcttatccagatcaaaatgattaacatggaaagaacacagatcttaaaaatcaatgtagagaataacattatttaccataagttgctgcaaaagtaattgccattaaaaataatggcaaaaacggcaattacttttgcaccaacctaataataatgaacatctgctgatattttagaaagaggggagtgaaattatcttaccaggtaatttttctttcttgtctttcagcataaacacagaggcaggaagagaaccatgtctggggctttcaagggtgatgatctgctattgaatgccaggctttccccaggttaatcttaatatctctcttctatgaggtcacaggtctacaatcataaaatagatcagttcttggaatcattcattctcagaaaataatgatcttggaagagagccttttacgaagactatcaggcctgggatatttctcctaatatctattctgcctatccatgggaatcgaacaatgattgagttgggccaggggtcttgccaacttgctggtcgtgggagatgtagtgaaaggactgttggatttggaggcaatatttctgggtcctgcttttggacatattccaagttaacttccttaagtttcaaattccctgtttcagagattgccaacctacaaacctcatgggtttttcttatgatcacttggtacaatgtatgcgaaagtgctttaaagtgacctagctctctatatatgtgaaccttactattattgtccttggaactttgacttgaatcctaaatcgtgggcattcagattccaatcttaaaagattttattcccagtgaagcactctactcagtttcctacaagattctgcattcacctgatgtactcaggctccttccttctctgtttggagaactcattgcaaagatgatgaagaggcatcagacctactttctcctcagataatgtgattagactccttcattattccagacatctctcttcctaggttgcctgtggaaatctgggacctgagtgaagcctggagttgacctgagagggagaacccatagacaaagtgatgtgaggtcaagccttagagtgagggaaaaagagtgtcatgaagtcagaaatgtggaagaatatgacccctgccgggcccgtctatcctgtcctgcttctgaatgtatgttgcacttcttctctcttgcaggcacctgcaaaagcttcctttgcagagtagcttcctgaaggatttatgcaagatcctttatctgaggagtgagttagagcaaccacaaaagcagacatcatgttgctcctgaagccaggggaagatacatatcttgtgatgtcacctttgggattctctgagttgtagctccctctggcctctttacttcttgcctccacctactgactggaccttatcacccacttacttttttcttcttagccgtataaccattggatttccttcctcagtcagagcctcctttgtcactggatcctatattgtcaggaccatcttaaacccctacaacttatctttttccttccacacccagagcacactcagataccaaactctatttctaacccagaccccatttatctttggatactgcctccttacctggccccacctcatcctatccttccactttcaggatctcaacaactcccctaatctgacacacttcaagtatccagtggttcagttcactgtcctccatctttcatggttccaagtgagggtccccaaaatgtttcagctatgtgaagccctggataatggcctctggcatgacttcagaaacacagccggagatccatcaggctgttcttcaccctgcccactctctgtctctgggaccatgtttctttcaggtcaaccagaatgtcctcctgcattccccactgcctgcaaaatttatctcaaagaaatgtttccactaaatcagagaaaattaatcggttttcatttaccacatcctccaaagtagattgtctctattataagtagtctatctatatttccctatatatttgtttttttctaaaaagaaaagtggccttttcttcagccatatttaggaaaggtttagggttagccaggagcttgggctcagaaaaccaaatgagtcaacctcagaccaaattgagagccagttttgactttttgaaggttatcagggctagggagggatgctgacagtgacatagcacaccggacatcgttttgggtttctttatttgcattttgactatatctcagtttaaaaagcttattaatataatattgccataaaaacacaacaaaaatacaaatacccaggggctttaaaaatgagataaaatgagaaaatctattaatcctccccttgataaggaccatgtaataatataacattatacagtcatgggatggagtagttggggttaagcaggcatcatagagccaaaaatttcctattcagcctgtaaaaacagtaggagacaagacacttcatatatccaaaaaatggcattagacctttgcagccctaagttcagaaggatagggataaatctccatgactttgaatcttttgatggcgaatagcttctacttgcccccagatctcccctctattcttgacataggatgtgagatgagcactgcttccaacaattcttttcttggccttaatgaaaaagtagagctgaccccaaatctactggctctgtacaggtggtgaggaggatgagaggaaggagaggaggcccaagaaaaggcagaataaaggttttagaaaatctggaataggaggagaacacactatcagactcgggaaaaatcttcatatgtcttcctatttcctcacactccttgagaaagaaatctccacgtatcttcaagtggccctcatatcagtagaaaagaactggtttcaaagctagggacatgaaaattgggtcaccttgatatacctctgaacctccacaagacagcccacatctgaaagtattcagagataaaaatattttcctgaaaacagtggtatttgttagaaaaactacccccaatggacacagaactgattgaactttagggggaggtggtgtttgtgtgatattgctgaggtggttactgctggagttgatgtggcaaagccaaggcacaaaataagtgatctgctatgggtttgtggggtttatttagacacagattttgaactcaataatgaattgtccccattgagtttctccaagggaaaccccttttcttggagactatatggtgcctagcttgatgacatcattgcagggcaagatatcatatagcaatcaggaagggaatgtttatgaggcagccacccaatggctgcagataaatgaggcccagtgaggaaagtggaggttgggggagcaggaaagaggaagaacaagtgaagaggggaggaatgacccactgagttggaaggaatgataatgccgtcatcgttcttagtcaagacatctccctctttctctcctgacacacacaacctggctcaggctccacatgcttacaactgatgagggcgctgtagagcacattggtgctatcctgtcaaaactatgtgggtgccctttgaacagaaagatgtctgcaggacatttgcagtctcattttgggtaagtcactttggtgccctttttccaggagttctttatgaaaatatacagtgtgagaatacagtgtgaatgtttggccctttagggttgaaggactcctttgaacttcatgtccttggtagagatgtataaaatctcctttgggcacacccagagctcacgccctacaggtagatcttgcaacttctggttaagatgcagtgtttctagggctcaccttggacccctactcaaaccgtgaaagtcaatgtgaacaaagttgccatgtaagttcacatccatgtcattcaggtcaatgctattgaaatgctgaatggagtagctcttagggaaacaaaagccccagataagtcattagggtattgcaaattaaagcaataaatttatcattatacatatataaggatagctaaaattaaaaaaactgacaatactaattattgtcaattgcagagcaacaaaacacatattcattacttgtggacatgcaagatgtccagtcatattggaagacatcctagcagtttcttacaaaattaaacagttttaccataggaaacaacaattgggctcctaagtatttacccaactgctttgaaaacatgtccaaaaaattttgctcataaatgtttacattatctttgttaataattgcccaaactttaaagcaaccaagatgtccatcaataggtcaattaataaaaatggtgtgatacccatgcaatataataacattaaatgattaaaagaaataagccaccaagccataaaaacactttaaatgcatactgtttagtgaaagaagccatcctgaaaaggacacatgattccaagtgtatgacattatggaaaaggcaacaaaatcatgatggtaaaaagctcagtgtagccaagagtttggagagagcatgtgtgtggtgaatagatgaaagtacgttttttaaggcagtgaagctattctgtattatcctataatggtggatatatgtctctatgcctttgtaaaagcctataaaactttatagcatgaggagtggaccttactgtatccaaatttaaaaaatcagttcagaggttgggagattctaagatgaatgcagaatttagcaaaacaatttaaaatgaattacaaatgtaggaaacaatcccactgaaggggaataaggtaaaagttgctgacctatgtaattttgaaaataagtggcatctgtaagtttaagagccaaacagtgtgttcataaacactgtactgtagttattaataaagttgtttcctgcaaggagatggattaagatttttgataatgctatatatgttgaaatattaagtaaattgaattatttaagtaaattgatgtcaagtggcgggagtaggtttctagccttagctagcttaaccagaaaaattaaatgttttaaagtatcggtaataaaaaagtataacaatgaagaaagtttactaaatatagttataaggcaaataatctcaaaaaacgttctattatcagtggtaattatacttatggtaaagatatattgttaccaaacccagatccggctgctcacctctcagaaagccaaacacaagagatgagaattggtgggagaaaaagcaggtttgtttggaaagccagcaaaactagcattttaaaatgccatctttaattgttcagtctggatggaggggaatatagggaagtagaggggactggtatcaacaggtgaccgaggactgcaagcaactgggtgccagcaatggccctgggaagttggggacaactttgtccttgatcaagtcacgatgcttccataaatctttaacaaaacatagttgcttacatacttcgcctttaatctcagagttagtttcaaaaactacatgattgctatttgtgcacattatcttagtgctctgaaattatcctagcctatgtgcaggaatggataaagtcctcttaaataaaaatgaagttagttatgttatagttcttttgctgttttactgttacagtgtcagttgttaataaaaaataaaagaaaattttaataaaatattctaggaatattacctgacactctaacaaaaagcaagttatattaccatttgtatcacacgtttgaaaaattctgatggactctacaatagtaggatgaatagagttaataattataagattttgttttgttttgtttttaagacactccgtctcactctgttgccccggggggagtgcagtggtacactctctgctcactgcaacctccacttcttaggctcaagcaatcctcccacctcagctgtctgagtagctgggactacaggtgcgcaccacaatgcccagctaatttttgtattttttgtacaggtgggatttcgctatgttgccctgctggtcttgaactcatgagctcaagcaatcttcccgtctcggcctctgaaagtgctgggcttgcaggctgagccactgcacctgcccgggtttttgagtgtcctcatcacaaagaaattgtaaatgtttaaggtgatggatgtactacttaccttgatttgatcattacaatgcatacatatatggaaacataactttgtaccccataaacattattattaagtgttcattgtaaatttcaaaaataaatttaaaagaattgaatataaaaacagatttacatgagagggaactgaatatacgtcaagtcaaaagtagaattcaattagagagaggcttagttttccatgctagacattccataatttaaataaaaaaggaattgtccagatctttgaatacaggtaaagttaaaaacaagtgtccatcacaagaacatggctacaatttttagaaaatgtatatctcagttattagaaatcataagatcataaacaaataatgtatatgacaacataaaatacagagaaatgtacatctcagtgattagaaatcatatcataaacaaataaggtatatgaccaacataaaatatagagtaaataaataacagaataaaatgagatctgattgtaaaatttgatagaaaaaaagaatattaacaagcaaataggtaaccgttgaagcttattacaaaataatattaattagaacactgatagattattattttattcaaataagcaattaattaaatcaaatattcaaatgttcacatgttttgtaccaatatattcgttctctgaaaataacttttttttttttttgagacggagtctccctctgtcaccaggctggagtgcggtgacgccatcttggctcaccgcaacctccgcctcctgggttcaagcgattctcctgcctcagcctcctgagtagctgggaccaccacgccaccacgcccagctaatttttgcattttttttttttagtagagacggggtttcaccatgttggccaggatggtccctatctcccgatcttgcgatcagcctgcctcgacctcccaaagcgctgggattacaggcatgaactactgcgcccgccctctgaaaataattctttaaaaacatattgcaaaaaacatgaaaaaaaatacaagaaacattaatccacattcttctctagatgccaccttatttcctttttccacttgacaaacaaacttccccaaataattttctatacgcagtattcttaatttctcttttttgtgtttcctcttcaacttactccaatcgtgtttctatcccattcattctactaaaccagatcctcctaaggtcatcagtggagtctgtttccaggttcagtaggacagctcagccctcaccttccctgaaagtaccactgtcttcccctcattagactctccctcattctttcccatttctctttctaattgcactggcaactttacctcaggctcctttacatattctccttctctgctctacctttgaatgttgagggtctgcaggacaaggttatgtcctcatctcattgtctcctctgtttataagtgactacattcattcctatgtccttgttaccagacatgcaataaagaatcttaaattaatacctttgcccatgggatttgttgttcactctagacccatattcccaattgcgcataagatttctgcaatttcatgtctcccaggcacctcaaaaaggacatctaatatttttctttctcaacatcatttgcacctaaagcttctagtatgagaacatcattttcttttacttatctttgtagtgtttcatataagcgaaattggtacatctttactgtttcttttcctgtaagaatgaaagctcttcaacacggaaagaaactgtgtttattcacctgtatttcttttttaaaataactttttaatttttgtgggtacatagtaagtgtatatatttattggttacatgagatattttgatacagtcatgcaatgagtacacctgcattgcttgacatcaattccaaaatatgccactttgatactcactttatacatattatgtaaatggaatgaatgaataggtaagtgtatattaccgtccattccttgatttggttcagaaaactagtgtttggattttggttttcgaataaataacttcaagaagttttgtttgaaaataatttaataaataacaaaatacaatatttaaccaaatggaaagctgaacatgttttgttatcttaatacaatgtaaaggcaaacatttgttatataagaatataaatagtataaatatgataaaatgtaagaataaataaatgagtaaaaataaataacatcttagggactgatgcccctgaacctaagtctttttaacatatactggcttaatataccgacaaagtatttgcagaactaattcagtcaattctgtgattaaagccgaaataagagtcttttgaattgaccagagtcacatgtgcaagtgttatatggcaaattaatcaatgagaatcatttcaagatgagcccaggtctctatctttacttctcagtctttcttgcatgtttgttgataagaacaaggatttcatgatttccattctgacaacttcccaggcacagtcgctgtatttcttctctttcaggtagacacggattccctggaagtacctcctcaaggtcagtgcagggctgctaattgccccagcagattctccttctcccactacctgcagcaagcaggtctccaggtgttgcagttgctgatgaagtccagtgtggagttggtctaggagggtcatgttccaggcagcagaggagcgctctgtgtggaagaggctgaagatctgctgcagcatctcatggaggacagacatgacatgggccttctgcaactggctcccttttaccatctcctgggggaacctgaagtctcttctgtccttgagacacaagaaaggggagattctcctcatttggtgcagaagcaccaaggtgttcctgctaagtaggccatggttctgaggcagatcacagcccagagatccaacagggctatagctggtcatcactagggctgccagtagagggaacaggagggccattgggaaatgaggatgctcctggctttactgagctgggatatggcttaaccttggaccctaggttttctgaagacattgcttgtatgcatggcttttaataggaaacacatggttttcattttctgaacatttctctgtactttcagtttcttttactgttttcatttgtgtgttctccctatgaccttaagaggatgacaacaatctattaattttgcattagacttcagctaaactccagtaaacttcagctgtgtcaatacaaatgaatgcttaatcaaatgaaaaacgtctgggtactaaagtcataagtgtatatactatatgcatgtaaataatcagacacacactacactaacaatatatatattatatatttatgtatacacactatagtgaatatatgtatatatgtgtatatataatatatattcatatatatatgaaaaaaatcattttctctgttctagaagcaaaattttaacccttattctagcctccatttttaccctccttactttatgtaggaagtcaggccctataggtttctatatttgcttcaggtttaccagatcatctgcagcaaataagctctttagaaccaagaacagcattttgctgttgtttgtttgttttttagagatggggtcttaatccgtcacccaggttggagtgtggtggcatgatcagaggtcactgcagcctttaactcctgggctcaagcaatctctgtgcctcagccccctgagtacctgggacaacaggtgtgcaccatcatgcctggctaatttttttgttgttgttgttgttagagatgaggtcccactatgttgttcaggctggtctcaaactcctggcctgaagctgaggcctcctgcctcagcctcccaagtagttggaattacagatatgagccaaaaacgcagttttgtttgctgttttattcacaacagaggatgatgatgattagcgaatgagcttctctgacatttttcttccttctagaaaacattcatgcaggtccatgtggttacgcttcactgggaccacaaggtgaagattaatatagacactgctttttctttccatcatttgcttactgaggtcaatagtgctcccctatctgtcaatatcccagctggaatcctgattctttacaagcgcatatggatgtagagattctaattcgcagatattttactttcccagcgtctcctcacacacaaggtagttatcacatctagtaataccttttcctctagagtaacaaatactctcaacccaaactcttccagactcgctcccagggagcagtctcacaacatcctgataacttcagaactcttttggtgagagggtagtggttactttgtgagcaaagcaactaaccctccaagacccttgccggtgcccctagagtgtttgtctggaggaccctggctctcagtggcgacctcctttcctcctgacccatgtgtccaggtatcaaaagtttcgacagccctcaggtactgatagcaaaggtttcttttgtctaaggaaggtggaaggattacccaattataatcattttaccttcattagtcaaataattttccaccatttgcttactgaggtcaatagtgctccactggctgtgtcagtatcccagctcggaatcctgacacggtttttattgttcaattcttttacgtaagctattgaacatttgttatcctcagtgtttctcaggtgggcacaggggatcaatgatgatgttgtctttcattagaagcttatatgtgccaaattttctagatccagtctatcgttgttggacatttgggttggttccaagtctttgctattgtgaatagtcccgcaataaacatacgtgtgcatgtgtctttatagcagcatgatttgtaatcctttgggtatatacccagtaatgggatggctgggtcaaatggtatttctagttctagatccctgaggaatcgccacgctgacttccacaatggtcgaactagtttacagtcccaccaacagtgtaaaagtgttcctgtttctccacatcctctccagcacctgttgtttcctgacttgttgatgatcgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatggggttgtttgtttttttcttgtaactttgtttgagttcattgtagattctggatattagccctttgtcatatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccctgcctatgtcctgaatggtattgcctaggttttcttctagggtttttatggttttaggtctaacatttaagtctttaatccatcttgaattaattttagtataaggtgtaaggaagcacaccagggcctgttgtagggtggggggaggggggagggatagcattaggagatgtacctaatgttaaatggcgagttaatgggtgcagcacaccaacatggcacatgtatacatatgtaacaaacctgcacgttgtgcacatgtaccctaaaacttcaagtataataataataaaaaaagaagcttatattacagaaactagtggtcttcagctgctcatccagtcattgcaattctaagggttctttcctcctctatctctgactcactctgacagtgcagggaggttagacccttgcttttctgtcagggagaaagagccttccttaatttacttatttgtgattgttttattttaaaattttgtaccttatttttacatagtggtttactgggtaaggtttgtcttgctgcttctgcattacattccagtttatgacaaaataacacaaattaaaggaagtaaaagaaaggcaaaggaaccatgctattttgatctataatttacatgaattcagatttttttctttttcatttcagctttcttagaaagcaaaacttgatagttgttttggggcaagaaagaaaacagaaaatataagtctgaatgtcatgaaagtgaaagaagggaagtggctttctgctcataaaatggccaagtataagttagcaaaataaaatgcagcaaaatcgatgactaggggttctggcagaggggaagaatgagcccaatgttgaggtacacaaaggcagggaaatggctgtttctgctagaggcacagagaaggccaagtcctgggtcaatgaattgctcttagctttgcaagaccagacatttgctcttttttcatttaatatacataggatcagttctgaggaaggaagggaagcatgatgccaactggctcacaagagattgtcaaccagtccccaattactagaacaagcagcctcctctggcaggataatagatattagccttgcctgagcactctaccaagttaataaatctacctaggcaaggaaaagagtgctttgagaaactcagtgtaaaaaataaagagaactggataatcgcaaagattccgctctttatctggataatgatgatgacgatgatactaaaaatgataacattggaatttgttgcatgttgactaagaccagcctctgttcaaagatatttgaaaagattaactcaatcttttcaataaccatatttagattccactcatttatacaactttctggagagaaatatgtatctggagagatgagctattccgaaaacaccagtgatttaaggtcaaacctttagggggagtcaatatagtggcttatctggaagactctatcaatggaagtggagggtggatatgagtagagaatttataaaccaaggagaggccagggcatgaagtcaggtgagcaggacgggtgagatgacaagggattcagagttccacgtcacatgccaatgtgttgccatctattactttgtagacagagcaacgggggtatgttgtgagtaagttgaactaattttaagtcctaagtaaaagtagaccttttaaatagttaaaagtgagtagatttttctgccaattgtaaaaaagggccaagatttaatgagtaatttattcactgaaatacagtaaaacctttattgactcatcaactgcaaacacttagaagcctttttacatttgactcttgagattttcttttgtcattttaagaataaacaggaagcacctaacaatttttagtctaacaatagcccagccatatgggctctgagtttctccctgaggatgtcattgattctccaggacacttccttcaggtcagcctgctgtttttattcctgaaagggacaactcacctccaggccagactttattttgtctactgatagattccaattaggaatttcttctcctcctaatcttaccagacaatggttgagtgtccagtgccaaaaagaacctattgtatgagccagagggcagactatatgtactttctatgaagcagtgaagggatacttaccagggataatcttgttttaaccccaaactccaccacagtacttagtatagatgtctttatttttctaacctcatcatatttaaaaaatcctaaaatacaatgacaggattgaaagaaacttgtcaaaaaaatcaccattggctggatatggtggctcttccctataatctcagtgctttgggaggccaaggcaggagttcaagaccagcctgagcaacatagcaagacattgtacatacaaaaataattagctgggcattgtggtatgcacctgtagttccagctactccgaaggctgaagtgggaagatcgcttgagcccagaagctggagattatagtgagctatgatcctcccactgcattccagcatgggtgacagagtgagaccctatctctaaaacaaagtaaaataaaataataatcaccattaatggataaaatgatcaaggcattttttggaatagtttcaataggattggtatccattcttctttttttgtccagtagaatttggctgtgaatccatctgatgcagggctttttattgttggtaagttttttctttgtttgtttgtttgttttttagtattgattcaatttcacgacttattatgggtatgttcgagtattcaatttcttcttgattcaatctttggaggttaaatgtttccaggaatgtatccatttattctaggttttctagtttgtgttcatagaagtgttcaaaacactctctgaagttttttgtatttctgtgaggttggtgtaacatcacttttgtcatatctgtgtttatttggatcttctctctttttctcttcattaatttagctagcagtatgtcaaccttatttattctttcaaaaatcaaacctttgttttcgtttcttttttgtatagattttcacatctcaatttctttcagttgaactctgattttggttatttcttttcttctgcaagctttggagttgttctactcttgttttcctagttctttttggtgtgatgttagcttgctaatttgggatctttctgactttttgatgtagccatttaatgctattaattttactcctaatactgatttagctgtgccccagagattctgaagggttgtatctttgttttcattagtttccaagaatttcttgatttttgccttaatttctttgtttacctgaaagtcatccaggaataggctgtctcatttccatgtagttacatggttctgagagagcttcttggtattaatttcaattattattgcaccatggtccaggagtgtgcttggtatgattttttttttattttgttgagaattgctttatggacaagcacgtggttgaccttagagtatgcactatgtgcagacgagaatgtgtactctgctgttgttgggtggagtgttctgtagatatctgttaggtacatttgatcaagtgttgcatttaggtctcaaatatatttgttagttttctgccttgttgatctgtctaacactgtcagtggggtttggaagtcttttgctattattgtgtagttatctaagtctctttgtaggtctctaaaaacttatgaatctgggcactctagttttgggtgcatatatatttagggtagtaagtcttcttgttaaatcgagctctttatgtaatgccattttttgttcttgttgattatactggtttaatgtctgttttatttgaaataagaataataacctttactctcttttttttttctgtttgtttgatagatctttctccatctctttactttgaatctgtggatatcattgcatgtgagatgggtttcttgatgacagcatacatttggatattgcttctttatccatcttgctactcggtcttttaaatgggggcatttaacccatttacattcaaggttaatattgacatgtgaggatttgatcctgtcattgtgttgttagcctgctgttatatagagttgggctgcagttggtttatagtgtcagtgggctaggtacttaagtgtgtttttgtggtggctggtaatagtctttcatttccatgttaaatacttccttaaggacctcttgtaaggaaggtctggtggtaacaaatttctttagcatttgtttatctgaaaaggattttatttctcctttgctaaggaagcttagtttggctggatataaaattcttggttggaatttcttttctttaaggatgctgaatataggcccgcaatctcttctggcttgtaaggtttctgctgaaaggtatgttgttagcctgatggggttccctttataggtgacctgcccctcctctctagctttcttcaatattttttcttccatgttaatgtcaaagaatctgatgactatgtgtctttggtatgttaattttgtatagtttcttgctggggttctctgaatttcctcaatttgtatgtcaacttctttagaaaggttggggaagctctgagtcttcaagctctgagattccttcctcagcttagtctattctgctgttaatacttctgattgtgttatataattcttgtaagagtttttcagctttagaagatcagctgtttcttttttgaaatggctatttcatctttcagctcttgtattattttattggattctttatattccttggattggatttcaactttctattgaatatcaatggtcttcatttccatacagattctgaattctatgtctgtcattctagccatcaattaagaaccactgctgggaagctagtgtggtcatttggaggtaagaagacactctggtttccagaagtgcctgagttcttgtgctgattctttctcatctgtataggttgatattcctttaatctttgaagctgctgtcctttgggtggggttttaaaattttacattctttgaagctcttgagagtttgactatggtataagttgggtttagttgattggtttcatttctggatgatttcaggggtacaagtttcagctcagcactcctgaacttcatgttttaatgctggggtgtgggggtactgggatcaggactatggctttttttctgtggtccctcaaggttaagcatttgatatgctggaggggccaaggtgttccttgtatgctggcaacagcactccaatgaggggtgctgccaaaaatacttcataggggaggtggtgggcagcaggggcccccatgtatgacacgctggaaaagcagcagggaaagtctacagtgagtgagccctggttggggagggctgtgggtgggtgcttgccagcaggggcccacttgcagttctctgactattaggtagggtctgttggtgaaagaactaaggcagtgcccactggcaagtgcctcggcttggcagcagaggccatgctgaaagtgggtgtagacaggcagtgtccctgggataggctggcagagcgtggggtgctcatattggactggcccatcccatgggaaagatagccctgttccattcaggtccagcagccaaaaaaggctaaagccacctagaggagcatgtgagccttggggaatgagctgtgctccattgcacctcttcctacacaaaccctcggctccacgcaggctggagttctgtctttttcaactctccaggtagctatccctgccatctcaaatgtctgtgggggttatggggtctcctgaagctagggttccagaggtctgtgacaagaatggctcactgtatgcctattttactcaccccttccccagaagctgctccaagtcaggaatgagtcctggagcttggcaacctcatgcagggttcccaactccctcccctttcagccctgggtctgcatcatccctccgtccactcttcatgccttctttccaaagatctgtttaaaatgtgccagtctacttgatgatctggtctttcttggtgagagaagttcttcctggctgtatctagttggccatcttggttctctctctgtctttcagaagtttttcgtgatccaccaacttaggacaatcaaatccttcatgacctagaacctagagtctgtgtcttttagaaatgacatcagaggaatattgactttgaactacattttaagggacgataccaagttcttcttatcacctacactgcagtaaaccttcaaggcctcaaacctttcatccacatctcacaactcaaaaaaattccttcagattcttggaactgcatacctaatttcctgctgtcctaatcatttctcatttttgttgtacaggaacgtccacgcgaccataatcagtgcaagctttcacttaagcttatgctgtaacacaaatccagagcaattgttgggtttgtgggctactaccaaaaaaagtcagaaaacaaatctactaatgccaatgtctgtgttctcaatgagactcacactgacacttcaaaggaagagtgaaaagctaatcatgaagctctgaacatcactgttacttgattttttacactcagtagaaacagcactctaacatttccaattaataatctgatcattaccaaatatagaaagcatattcaagtgttgcctgaacaaaagtatattttgcttccaggtaatgcatgtttgagacttaggaattacccatgttggtaaaaataattgcttgtataatgtcaccagattaaatcaaataaagtcctttttcagcaaatgtggttatatacccttacagattgctataaataaaccaccaaaaaaaagtaaatttccattgggctttgtcagtagctatgaagatttacgggtaaacaaatttaactgatccttgctcaaacacaactaggttttcctttttccaaccactgaaggctgggtctgtggagaatctgcttattccattctgcctcctcactagtttgaatcattctatttggcttggctcactcctgcctttggattaactttccctgaatgtccccataatagctcatatgatcagaggccaaaatagtcaataaccagaattaattaactaaccttcaaatagacaaagacaagctagtttccctagtgggactcctggggtcttgttcttggtggtagttgggtactgattatgtaaaattggaagctaatctttaatttgggaaaaatcttgaattttgtagacaatcaaaccttccagggtttcacatgggtataagccactcattgaaggatagataagaacatatatcttcaaccaaaacacttagtgaaacatcatgtagctttagatcattttgcccaagttggaggcttatgtttggtattgaaaaaaactgaatactgtacctatctttcccctgagtttgttactatagaaagattagaaaggtgactaatactgctgttttcttagactttgccaccaaacacattaagaaaatttcgtaagagaaagaaacacataatgtatttgtatatgttttgaggtagggtcttgctctgctgtccacactggagtgcagtggcatgatcatagtacactggagcctcaaactcctgggcttgaggaatcctcatgcctcagcctcccaagtagctggaactagatgtgcatgccaccctacctggctaacttttttttttgtattttttaaacataggaatatgatctcactttgtttctcaagctgatcttgaactctgggtttcaagcaatcctcccaccttggtcttccaaattgctggaattacagataaaagccaccacacgcagcccacataaagtgtttatgggagcaactaacagttggtttgcaggcagcctaaataggggatggcaaggttgggttttccaaggttttctaatctttctatttcttctagtgagtcttcaggttattatgacttgtgttaccagactatcaacaaaagtgggtacctctttaaatcaggcctatttatggtgaattatagttcttaatcaccatcacacccttaagacagactatgaacaattagactcaaatactgcttaactgcctagattgcctgcactttgacttgtttgatttggttcagtttatttcacaaggacttttgttaaggagtaccctttgggtttttgaaattatcctcttgatagtcatcataatattccccgtggtgcactgtatcctctccagtcctaaatgttttgtatgcagccatccattgagcatttaatgatctttaactagatcagcaagaacataaagaatgtttcaactaatgtgttgttgagacttgtgaatttcatactgagaccaaagacgtccatttagaatgataacagagagtggcaacaacacccaaagttatggtcaatttctcaaaattgagaggctgaccacaaagaaaagtttattaaactaagtttagcctgagtgagcttctgtactcacgtagttcttacgtaatgaattgtaatgtaacttagtacctaaataatctgaaagcctaatttggagtatacttctgtaatgaatagctgagtcccagccaatcatcacacttgtgcttcattcaatcacaggtggctgcttattcaaaccatgttcaaataaggctaatgccaagctataaccaatctagctctttatatacctcacttctttttttctgtatatcactttcctttttctgttgataaatgtaatccaatcatggggcagcctcaaagtttctctgaacatgttctgctctgagagctgccccatttgcaaatcagtttttgctcaattaaactctgcaaaatgtaatttgtgtaaattttttcttttaactctggatataattgggatataattacagagtttttcagggtaaggtgagaatgcagagcgaaatcatgcaatgtttgcccactgaacataaaatgacaaacaacaaaaaagtaaaattacattagagaaataagcagcataaagaaataaccaaagaattgaaggggtcataatatttgaaaggtgttaaacaatgagagagagagagacagagactgacccaggtgaatccagaaatatattttttgttgcgtgctcctgaactgagcccctataaacagtggacaaagaaagaaaggcaaggataaaaatattgtcaaatattataactttgagtttcccaactcatcccttctcccatctagcaagaagaaatctaaacattgggtttgtaatgtgagcaaacatttggaagattcctcctccattgaagccccttcctgctagctgagcaattcacacaaacttcctgattaacttcttcaattacaacattgcacaaacttatgcttcctaaattttacccaatggaccacatgctttcatttggcaattattgtattctctgaaattccttcacttatgtcttgctgtatcttactactactggacgggatacaagtctgtcaaaattcaaacaacaatgagaatttctcctaactacaaagtcaagtgacatgatctaataggagtgaatttgtaaattagcaaggtatttttttaaaaagaattaatgtaatatcaaacaagaggtttttctttattttccttgcagttctatacctagatgggcaggctgtacttattcctagtgtagctcaatacgtggagggagggatgagtcaggaggccctggaagcctgagcaggctggaggcaagggacacatcctgaccctttctgtctccacatagctgcccattgcccaaaaaagaggacgggtcctgcttgaagctggcattatttcccctctgtaagacacaaagctaaggaaatgaactttcagaattgaggtcagttcttttcaggaaagagctcattttagctctgtagaaaaatcttctgccagggaacaggattgtgtgtagaagagaaggctgctcgccagacttggctgctgtttctgtcagtcacgatcagtaggtggctctcttcctctgtaaatcttttgataacccccagggtaaaatggatcctgccctctgtttcctttttgctgcaactactattacatcattgtaacagtaatattcccttaattccaaaaatatttaccaggagagaaaaaggcctctcatacgtgagtttctgaaaaaccaaaaatttgcactcaactattgctttcaattggtaattgtgtacactttagggggaaattgacagccagaaaccacaatggaagagaaagcagctatatgactgggcagtgcaggttaatgaggagtgaatgtagagggcacactgaagatttctacactggagagggaggaaactattatgatatgggaatgaaagaatgggaaagagggaggaaagaaaactggcaggcaacagaattagcaaatgaaatatatgtgtgtgtgtgtgtgtgtgtgtgtgtgtatgcacacaaatgtgtataggcatttatatacacacatatatacacatatctgtatatattatgtattacctactatatattatatgtattatgtactatatattatatactctgtaatatattgttaaaatatatattattataatatatattgaaataagttatacataatataataatatataatatatatacacttttaacttcagtttaggagactaatccatgcaccagatacttacaaaccatcaatttttgattaaatattaatcacatatcttcagtgtcaaatggtatctaattttgagtcttcttcagaactcccatttctcttttttcagactgtcagcattttgcagccgcttacagacagtggaataggagagttgactattcttatatagatctgtatgaatcaataagaaaatagtcaccatctcttaagcactctggaagatactctgctaagtgctttaaaatgttttagtttttctgatacagaaactccaggaatatttccatcttattttacatttgtgaaaactgaggctcagaggggttaattgaattacccaggatcacagatgtgtcctggctgaatctagattcaatgcagaattctatattgcgtaagtaattacttaaattttatagtttgaaattctgatacattttaatccccaaattatacactcttgctcattagccatctttcattcatggatgctgttgtatatttaaactgattttcaccctatattgctctttaattttgatactggggaagagaaatattctgatccagtttcacttttccatcttataaaggaactgtcccagattgttatgttcattgtaaattgattatttgtgaatccctaagagttaacagtttttatgaaatcattgttctacttatagatcaagtcttaatttagtcagaaagaaaggaagtgatagagaagaataatgagaataataaatatttcttttttgtttttttttttcttttagacagtgactcacgctgttccccaggctggatggagtgcagtggcatactcatggctcactgcagcctcgacctcctggactcaagccattctcctatttcagcctccctagtagctgctactaaggacatgtgccaccatgcccagctaatttttttttttcttttgtagagatgggtttttttccatgttgcccaggctggtctcaaactcctggctcaagcaatctgcctaccttggcctctcaaagtgctgagattataggtgtgaaccactgcactcagctgaggcatgtttttaaataacagtaaaaacaatgtgataaaaagaaacctaggtaaccagattattaaaacacatgattcctaaaaaatattatattatagtggtaattaaatttaggagaaagaacttatctgatattaaaatggtaaaagtgatattcaataaaatggctctagggtgatcgtgattactaacaatcaatgcaaagtctcctgtcaagtgatagatgaaaatatgatcttgatggaatacaggacagacataagattagattttttgaaagagaatttgtacagtacaagttttattaactatttattatgaaggcttgagcttatcctactaccttaacaatgacataactgacaaaaaaatatatgcagcataattttacagaaattggatgacagacagctctggaatgtgaccctaatgcaaacaaaaaaacaaacaaacaaaaatcttgtgtttcacaattaacctactctcctcctggaggtttagtgaagaaaagaaatagaagatataaataaaaatcaatattaactttttgagatgaaaaatgcagtactttaaatgagataattaagtgtagaggtaaagctcagttactttaaaggcatagcagtagaatctgtcaaaaaggaggcatggaatgaaatgaacctctgatacttggagtaccagaagaaggaagaggagagttaatgaaaatatttgaagaaataatatctggtgattttctgaattagattaaaacaaaacaaaaaaatttatgaattcaagaagctcaataaatttcaggcagcataaacatgaatatatatttaaaaccacaacaaaacacatcattataaaatttctgagaacaagtgataaaaatcttaaaagcagttaccaataaaaaacacattacatataaagaaagataagaatgctttcaaacatctcattaaatagcatgcaaggtagatgccaattaaatggcatgtttaaaagttgaaaggaaaaaataacaccaaacttgttaacctggaatgttatatccagcaaatatatacttcaaaaatgaaagtaaaattaagactttttcagggaaatggaaattgagagaattatcactaccagaactatactacaaatattgttttaaaatgttcttcaagcagagatgaaattatatcagatgaaagcttggagctacacaaaataatgtatgagattgtttaataaaaataaaaaatttattcagtgatacaaaacacatgtagcataataaatacagcacaatagctcaatgtctaggtagtgtatgataatttaaaatatgtgatgaacgctacagaaaaactaaaaacaaaacagactagaagaatagctgataaaatgatagtggagatgagggaattattaaaacggtaaactaatttaggagaaggcaagaaattaagaaagaaaggaacaaggaccacaggaagaaataaaataagcaagatgggaaacatacacccaaacatatgcataattagattaaatttttattgtctaaactttccactaaaaaagtagagattgctatactgggaagacaaaagcaaaacaaaaaccaaaaaccaagcaaacaaaaataagactcaaacaaaaagatccaactttatatataaaaacacaggttacaattaaagatggaaaaattataccatgaacacactactcattagaaagcagaaatgactatattttgttatacatagtaaaatggttactgtatgtaatgtgttcttctacagacttcttttggacactaatatagatcatatgctgggttataaacaagtttctgtataatgaaaagaattaaaatgatagagtatgctgtttaatttcaagcgaaacaaacctagaaaacagtagcatagtccaggcgcggtggctcacgcctgtaatcccagcactttgggaggctgaggcatgtggatcacttcaggtcaagagtttgagaccagcctggccaacatgacgaaaccccgtctctactaaaaatataaaaattaggctcctgtaattccagctacttggaaggctgatgcaggagaatcgcttgaactcgggaggtggaggttgcagtgagccgagattgagccactgcactccagcctgggcatcagagtgtgactccatctcaaaaacaaaaacagaaacaaaaacaaaaacaaaaaccagtagcataaagatatctgaaaaactcccaaatatttgaaaattaaataatacacttttaagtaattcatggatcaaagaagaaatgtcaaaagatatgagaaaatattttgaaacgaacaaaaaatacaacatatcaaaatttgtgagacacagctaaaacacggttaaagtataatttaagtctttaaatgcttattttagaagagaagtccaaaatcaacattctgcattttccaccttaacaactagatgccagtcactgtggctcacccgagtaatcccagcactttgggaggccgaggcaggtggatcacctgaggtcaggagtttgagaccagcatgaccaatatggtgaaacaccgtctctactaaaaatacaaaaattagctgggtgtggtggtgtgcacctgtaatcccagctactcggtaggctgagacaggagaatagcttgaacccaggaggcggaggttgtagtgatctgagatcaagccactgcactccagcctgggcgacagagtgagactccttctaaaaaaaaaaaaaaaaaaaaaaaaagcaaaaaacaaattagaattagaagaaattaaacaaaaattatatagaaaacatatagaagaaacaataaagggaagagtgaaaaatcaaggaaatagaaaaactgtaaagcaaatttaagaaaacaaaagctttttgttgttgttgttgttgttttaaattaggactctagcaggacccatctaggtaaaaatagaggaaacaacttaccacacttttataattattcatccttgaacctactccagtctggtttctgcctcatcaagtctgccatgccacatcttactaaagtcaccaatggcatctaggttttcatatccactgagatagtttagtcctaacctttcctaagtgcatcattcaatttttaaaccctttattttatttttcaatactttctgatgataattctctcctgattgtctcctaactgtactcaccactccatttctgcacgctttgctcttctcttccctaatcttgtaaattgacgatcttcctaagatttaggtcatcttctcattctacactgtacttataagtaaacacatacattaccatgcccagattcctacaaatcatgtccagcttatatactgttgaagattccaaatccacatatgaatttaccaataggacataaacatatacattgcaatgaccagattcctgcaaattaggtccagcttatacattgttgaagattccaaatccacatatgaatttaccaatggggcatctgtttttagatgtttcagaggaactttatggagtacacctgtttgtttcctttcttgttatccctttttcaagcttctgatgagagaatcctttgtcctcgacatctcatgaaaacataattgaaatgtattaaccatgattactatttttttctttctctaaaatggaaagttatgagaggatgttttacatttgctttatttacctatatatttccagaaaaattgcataatatggcatagaagtatgccattttaaaacataatctgattgaaataagtgaatgagggagttgaattcaataatctagcttgcaaatttagattatttccttttttttttaagaagaaacatacccaagaagtcttttggggaagaatgtaataaatattttaaaaagtaaataaatgtaaaaaatgaatagaatataattggacacaaggtaaaggtgaacatatttcattatattttaatatattataaagatgaacaagctatatgacaagaactactttaaatatcataaataatatatcttagataaagcatatgagtgaatatagaaatgcattagagcccttagcatattaatcattgttatttaaaatttgttttgataatttcaaaatctctgtcatatctggacttagttctgatgcttactctatcttttcaaactatgtgtttcatcttttagcgtaccttgttaattttttgctgaaaggtggacatgatggattgagtaaaaggagctgaggaaaattgacccttaatgtgagggtattttaaaaatctagtcaagtgaagcagtgggagtggagagggaacaaaggaatctgtaactggttgtgatggattagttgtaaacaccactgcactcagaccagcccagtgtaagcctttgtggttatcttgctggtggttaggctgcgtttcctgtttcctgtagctttatgtgtcagaagctaaaatttgctcttgtgtccttgcatttgtctcccaatttgtctttggatttccctagagattccttcttaaagtctaagtctaaaatttgcagttattttcagttgaaatcctgttattatacaggaaccctattaatgtgatggtagatgtgatggttaattttaggtgtcaacttttgacttttatgtatgtgtatatatatatatatatatatatatataaacatatatatatgtttctttattcactcattgattgatgggcatttgggctggttccacatttttgcaattgtgaattttgctgctataaatatgcgtttgcaagtatatttttcacatgttgacttattttcctctgggtagatacctagtagtaggattgctggattgaatggtagttctactttagttctttaaggaatctccacactgttttccatagtggttgtactagtttacattcccaccagcagtgtgaaagtgttaccttttcactgcatcccctccaacatctattatttttggatttttttattatggccattcctgcaagagtaaggtggtatcacattgtggttttgatttgtattttcctgatcattagtgatgttgagcattttttcatgtttgttgaccatttgtatgtcttcttttgagaattgtctattcatgtcattagcccattttttgatgaggttgtttgtttttttcttgctaatttgttttaggtccttgtttcataccggggatgcagggatggtttaacatacgcaagtcaataaatgtaatacatcacataaacagaattaaaaacaaaaatcacatgatcatcacaattgatgcagaaaaagcatttgacaaaatccagcatcgctttatgattaaaaccctaagcaaaatcggcatggaggggacatgcattaaggaaacaaaggccatctatgaaaacccacagccaacataatactgaatggggaatagttgaaagcattccctctgataactggaatcagacaagaatgcccactctcactacttctattcaacatagtactggaagtcctagccagaacaatcagacaagagaaagaaatcaagggcatccaaattggtaaagaggaagtcaaactgttgctgtttgctgatgatatgcttctatacctagaaaaccataaagaggtctccaaaaagcttctagaactaataaatgaattcagcaaagttgcaggatacaaaattaatgtacacaaatcagtagctctgctctacaccaacagtgaccaagctgagaatcaaatcaagaactcaaccccttttacaatagctgtaaaaaaattaaatacttaggaatatgcctaaccaaggaggtgaaagacctctagaaggaaaactacaaaacactgctgaaagaaatcgtagatgacacaaacaaatagaaacacatctcatgctcatgggtgggtagaacgaatattttgaaaatgaccatactgccaaaagcaatgtacaaatgcaatgcaattcccatcccaatacaaccatcattctttacagatctctagacaatcctaaaattcttatggaatttgagcctgcatagccaaagcaagactaagtgaaaagaacaaatctggaggcatcacatgacctgacttcaaactatactataaggccatagtcaccaaaacagcatggtactggtataaaaataggcaaatagaccaatggaacagaatggagaacccagaaataaacccaaatgcttacagccaactgaactttgatgaagcaaacaaaaacataaagtggggaaaggacaccctattcaacaaatggtgatgagataattggcaagctacatgtagaagaatgcaactggatcctcatctctcaccttatacaaaaatcaactcaaaatggatcaaagacttaaatgtaaaacctgaatccataaaaattctagaatataacacctgaatagaatagaatagaacaccggaaaaatccttctagacattggcttctagatataattctagatcaaagactaagacctgaaaccataaaaattctagaagataacaccagaaaaacccttctagacattggcttaggcaaagacttcttgaccaagaacccaatagcaaatgcaacaaaaacaatgataaataggtgggacttaattaaactaaaaagtttctgcacagcaaaagaaaccatcagcagagtaaacagacaacccacagagtggaagaaaatcttcacaatctatacatctgagacaggatttattagacccctttgacaagtaacctccttaggagaaaggcctatatcttgttcactcttttatcattatcacaggtctcatagtaatgactcaagatacaattattaacaagtatcatattccagtaggatacaattattaacaactatcacattccaataggtgtagctaaaaacataaaaaaaagacagttgttaacaaatagtgttctcagattttctcttaaaaaggagcactttcagccaggcatagtggctcatgcctgtaatcctagcactttaggaggctgaggcgagcagatcacttgacatcagaagttcaaaaccagcctggccaacatggtgaaacatcatctctaataaaacataaaaatacaaaattgtctgagcatggtagtgcacacctgtagtcccagctacttggaagactgaggcatgagaattgcttgagcctgtgagccaggggttgcagtgagctgagattgtgccatagcactccagcctgggcaacagaacgagacactgtctcaaaaatgaaaacaagcaaagaaacaaaaaaaccaggaagactttcaagtgtggccatgtccatgtgactgtgcctcaccaaggcctcaggtgcaggattgttgcaagagtttttcactcagtattgttgtcaaaatcactggctagcttatatgttttaattgcacatgggtgtgccaattttaattccaagacccacaacattgttatcctttccccagcacaatctcacctctcagagagcacaactttaatctgaccctctggatctgagtgctcacagacacacctcttccaatctaactcttgccaacacactaatgtgatagtacaagttagctcatcacaacttgaaacttttagtatacctttactatagggtgattgcttttgttccctaaacaatcaaatatctccagagtacttctgtgaatgacctaggttggcagcagtaacctcatcttcctttgatcagatacttaggtgtcaagtgtcttcatagcctccagatgacaaaagcaaaaatgtatgctcaatatgtgtgcatgtggtcagggggtgggtaaattatcctttttaaatttttatcttagatagcaaaataaatttatttgccaattgttgatttctaatttgagttcaatgcattaaactgttgaacatttattacgctccaaatttcttagctagccagaggattcaatgattactttttcttataaggaggtcatattgaagtaactactgaatgtcccttcatttttccattggtgcatttctactgagcttcttggtttaccattctccacctcacaataaaaatgtggggcaataaagtccagaatatgatgctagataaaattactcttccttactggtctcattgtctttctatatatatctatctctctctctatatatatatatttctatatctatctatctatctatctatctatctatctatctatctacataattaaattagtatttttctttgccagggttgtcttattgcttctgaattactccctatttcatcttgagtttagtacctcaacagggaaataaaaatgtaaagaatctggtaatgcaaagaatctgtattattatttcccataattttcaagtcatcatttttctttctccattaaacttttttaataagccgttattacatttgcataagttgaggcaaaagaagaaatgtaagtctcaatataataaaagtaaaagaaacaaagtgactctctagatgaaaaaagaaaatggaagttcttgttttctcttatcctttcacctacctcagtatggtttctgcttattacttccacttgtccatttctcataaggtcagcaatgatctgtgttcccactgtagtgaatggtttcaatccacagagcagtttaatgacatttaacatagtattaatcaaaataatgaagaaaaacaatgattattataattaattaaagtgtcataatttcaaatcaaaatattaaacatattaaagtggtttggctgtccatcaaattcacaaaatctatccagagacaaatatattttttgaagtaaaaattattcagagaaaaaaaatccacattcttttcaaagtcccactctatttctgtcctccaattctgaaagcaaacttcaaaatcattttctatatgtattgtcactgatttctcttctccgattcactcttccagcttactccactatgattaattccacccaactatctctatcagcagcaatgccatctattttccagatgtagtgtacactttcaatccacattttgcaagaatgcattgattcttctaagcagtttcagtcttttaaatatgcttttaacaacattttttcttgtcccaatgcatggccattcaaactctttcctggctcttctctccctttaaagttgaagtttgcaggaataaattttaagtgtttttctcattctattcaacccatgtgacatattctgttcccaagctttcacttcatggtattgcttgtaaattacagacaaaaatatcaggttaccaatggacacttgcacttagatgtctacttgtctgctatagaggatatctactacttttttaaaaaaaattttgatatgccttgcttcagttttactgaatttcatttgtttttatttcttctcactatagcatttaatgtaacaggtattagaaagtatagttattattttccttacaaaaataaaagatacaagaaagcgaaaacggtatttgttatgttcacctggatatcctaagggcaatataaaacctcgcttagagaaagtcaatttttacttacaatttggatacaatgatgatgggtaaatgaattgtaccatccattctttaatgagattgcacatttgggcttggtatttctttattaaagaataaacaaataatataagaagttttaatagtaaaaattaataaaaagaaaataatatattgactaaatataaataacatattttgatataacacaatgtaaaagtacacataatattacatggacaaaaataatttaaatctaataaataaataaatatttcaatagatagataattagatctatcagcatggtcatctgtaaaggactagtgcctgcacaggtaaacatgatgtttccttacactcctgaaaagatctgaaaattttgattcaactcatgcggtggttataggagaaatgagtctttgaaatggcagaagtcatagaagtgtggactggtgtattagtcaatacagatcatttccatgttgaaacaggtttcattccttcctccttaatctttcttgaaaaatttttgataaagagaaggatctcatgatttctgctctgacaacctcccaggcacaagggctgtatttcttctctgtcagataaagagtgattctttggaagtatttcttcacagccaggatggagtccacattcatcaggggagtctcttccaccccaacctcctgtatcacgcaggcttccaggtcattcagctgctggttaagttcagtggaaaatttttctaggaggctctgttcccaagtagcagatgagtcctttgtgctgaagagattgaaggtctgctggatcatctcatggaggacagagatggcttgagccttctggaactggttgccatcaaactcctcctgggggaatccaaagtcatgtctgtccttcaggcaggagaaaggagagattcttcccatttgtgccaggagtatcaaggccctcctattacccaggctgtgggtctgaggcagatcacagcccagagaacagatggatttgtagctgagcaccagcacggccatcagtaaagaaaaggacagggccattgggatgttgccaatattgctaggctacttgagatgggtaaccttgaaccttggcctctaggttttctgaagactttgctctgtgcgtaggtcttaaatagtgaacatactaatttccattttctaaatgccctagttttactttctatctctgtttttgctttctttatgcactctctacatgtgtttacagatgtttttcattttttttcatcattgcctatttttcccctgcactcaaaacattttatggtatttttttctaattgaaatcttcatgaaattttagtaacacagatttggcttatctatttatgtataatatgtatatctctacttcacagataaaaactataaagtttgctctttttattcaaagtaaagaatgacagaaatgttaaactaaaatctaagtttaaaagctattgacatttaacttaatttgataagtatatttgtggaataacttttaatgtaatttgttcatgtaaattttgttttatgaaattacatatgcaaaataaaaatctatataaatacacattaataatatgaatataattacatagttaatcattcaaaactgctaaaaatatgaatcaataattttttaaaatttttctcatagtatatatatgaagctttgaattttgctttatatgacaaaataatttgtaaacttaactagctccagcattcatccagatattgccaacacatttttcttttcagcacttgacataaatattgatgtgttgaataactttagtagaaataaatcacataatataagctatttgcattgaattctcaaagtctacaaaacatcctgaagaactgaggatcaaacataagcaataaccataagatagtcaatgacagcccaaagatatgcaggttaaagccacatattgtgataagactttaagatccagcaaaaaaaaaatggacaaaaagtcctccaatcacagtcatctatttgccataggtttgtaacactgatcttgctaatattttgtttatcttcatgaactcaataccgtgcttctcatatcatacacaagaaaacccaatgagaaagatgtatattaagcaatgaaattttgttggatagagttgttggagaatcacaaactattgtaatatgtgagatttgtttatactatgagaactaatttttgtactcttagaagaagtatcattctaataaatatatgtgacttagaaaatattatcaattaaatcatttttggcatttttcattgaagttcacattccctaaaggttttcagaagttcctatccaagtcaattcttatgaaaaaagagaccatctttgttctaaattcataaatttataaatattgaatattatcatgtaaagaattaactttcagagtggtcctgaactctgggtctacttttttttttttttttttgcataagaagttagtttgcctctgccctatagatactgagtccttaaatggaatgaggtctgttttagcaaatcagctatttagtaagtggagtttttctagtttctcattttttcttctactggaaagtgttcaagaatgaggctatttttcttcatcatggccatatttgctgcaattataagacaatgacaaaaatttccattcagcttttactcagaatcaataatgcccattaagtttactgctaaaaccagtgggattctggggattcaagttgcaagagcagcataatattatcctttgcctggcactatattaactatttatgaccttatctctaatctgtcctctactttgttataatagaaaataactagcctggtgtcaaatacagagtcacatatctgaattcaaactctccaattcacacggtttataggaatcagaaaatttactattcccaaaattagggaataatagcctctgtcctccagataatcctacagctttccttccctggatcaaatcccgagaatgtgtatgtgaactgtaaatacttgtgacatcatttttccatcatatataaatttcagcttcaaatcacgtgataatctttagatgacactggtagaaaatcagcctgtttatataaaggtagagattatgaaatggaccaattttagaaaataaccaaacacattttattattcattattttaaatgattcacttacattctttgtataattgaacaattaaaatattctacattgtgaaatgtgcacaggggtttccataatagaggaggtttcatttcagaaatgtatattttctacatcaatttagtagttgatccagtcagcaaatttgtattgaattttgggctcatcctttgtatcagaccctgagaataaagggcaattttgcccaagttattattcttagtctttgaaacactgggggagagagtaatttttctttgttcacttgagatcgtattgggaatttttgcatattaattttcatgtagtattttactgtgaaaatttgtttttctatactttgatttcattttcatattcaggttagtgtcaatgaaagagtataaatataatgtttaaatggactatacaattgttctatgtggcattcacaacaacaaatacattcatatttctcacttcacttttcctagaaggtagaagtggtctgatttttcatcttaatttatgggaacaaaaagaaaacaaacatatgtctaaatgtgataaacatggaagaggagaaatacctaatgtaaatgacacattaatgggtgcagcaaaccaacatggcacatgtacacctatgtaacaaatttgcccgttgtgcacttgtaccctagaacttaaagtataataataataataaaaaacgtgacaagaggggaacttagaaaacatcttgagacagatgaaaatgaaaacacaacataccaaaacatatgtgatgcagtgaaatcagaactaaaggggaaattgaaagctgtaaaagcttatattaaaaaagaagaaagacctcaaaccaatgaactaactacaaattaaggaactagaaaaagaagaaataaacacatagctaggaagaggaagaaaataagaaagactaaagcagaaattaataaaatacagaatagaaaagcaattaaaaaatcaatggaactaagcattagtcttttgaaaggatcaacaaaattgacaaacccttaactattttaagaaataagtagagaaaaatcaaataaaaatcagaaataagagaggacacataacagctgatggcatagacctaaaaaggatcagccgggcgcgctggctcacgcctgtaatcccagcactttgagaggccgaggcgggcagatcacgatgtcaggagatcgagaccatcctggctaacacggtgaaaccccatctctactaaaaatacaaaaaagaaattagccgggcgtggtggcgggcgcctgtagtcgaggctactcaggaggctgtggcaggagataggtctgaacccgggaggcggagcttgcagtgagccaagatcgcgccactgcactccaacctgggcgacagagcaagacttcatctcaaaaaaaaaaaaaaaaaaaaaagtaaaatggattataacagactactacgaacaattatactccaacaaattgattaacttagaagaaatatataaattcctagaaacaaacaacttaccaagaccaaatcatgaataaacaaaaaatctgactagacctataactagtaaggagattgaatcagtcaccaaacttcccaataacaacaacaataaaaaaccataatcagatggcttcagtggataattctatcaaacatttagggaattaacaccaatctttctcaaaatcttccaaaaaattgaaaaggaaggaatagtttcaaactcattttatgagactagcattttcctgataacaaagccagacaaggacactacaagaaaagaaaactaacagatccatatccatgataaatgttgatacaaaaatcctcactaaaatacttgtaaaccaaattcaacagcacaataaaaggattatagatcacgaccaaaggggatttattacttggatggaagaatgtttcaacatatgaaaattaatcaatgcaatacatcacattaacaaaatgaatgaaaaatatacataataatctctacagatacggaaaaagaaatagacaaaatgccatatcttttcatgataaaaacatttaacaaacttggaataaaaggaagttacctccacataataaaggccatgtacgaaaagcccacaattaacattatattcaatggtgagaaactgaaggcttttcctctaagatcaggaacaagtagggatgccattgttaccacttttatacaacataacatttgtagatctagccatagcaattaacaagaaaaagaaataaaaagcattcatattggaaaggaagaagtaaaattatctttttgcagatagcctgatcgtgtatgtagaaaacctaaagttcacacacacgcatgcactcacatacaaactgttagaactaataaatgaattcagcatagttgtagaatacaaaattaagatgcaaaaatgagtagcatttttatatgctaacaatggacaaatctgaaaaggaaacttaaaaaaaaaccacatttgcaatagcatcaaaacaataaagtactgaggaataaacttaaagaaagtggaaaaagatttatatattgaaaactagcaatcactgctgaaagaaattaaggaagagaaatgagaagacatttctgttcatggttgggaagcccatcatcgttatagtgttcaaactatccaaagcaatagacagatacaatgcaagccctatcaaaatcactaaggcatttttggcagaagtagaaaaatctgtcctaaaactcttatggaatcttgaaggaccagaatcaatcttcagaaagacaagcaaagctagaggcctcaccctacctgattttgaaacacattacaagcctacagtaatagaaatggaatgatactgatataaagatggacatataggccaatgggagagaatagaaagcccagaagtaaactctcatgtatatggtcaaatgaactttgacaaaagtgccaaggctacacaatggttaaagatcaactcttcaaaaatcaggttgtgaaaactgtatatacacatgcaaaggaatgaagttgcatccttactgtacactatatgctaaaattaactcaaaatagatcaaagatttaaacataagacctgaaactgtaaaaactttagaagaaaatcttcagggaaggctcagacaatgggtttggcaatgaaatcttggatatcacaccaaaacacaggtaactaaagtaaaaatagataaattggagtatacaaagattaaaaatcactgtgcattcaaggacaaaatcaagagtcaaaactcaaacctcagaatggcagaaaatatttgcaaatcatgtatttgataaaagtaatagcctattcagaacatagaaggaactcccatatctcaacaaaaaaatataacttgagtaaggaatatgaatagatatttattcaaaaaagatatacaaatggccaacaagcatatttctctggcctgaatgtttgtgccctgccaaaattcatatgttgaaaccctaactcttagggcgatggtgttaggacatgcgcctttttgggatgtgattaattccattgtggctcattgtgaaataggacacgggccacaatcacacaccaaatctgctggtaccttgattcttgggctttccaccctccagaactgtgagaaataaatttatgttatttataaactacctaattgatgatatttcattatagcaacctgaatgaactaaggaacataggaaaagatcctcaacatcactattagggaaatgcaaatcaaagtcacaatgagatttgaattcacatctatcaaggtggctaccatcaaaataaataaaataacaagtgttggtgaagatgtggagaaattggaacccttgtgcactgttggtggaaatgtaaaatggtgcagcgcagccacaatggaaaacaggtatctcaaaaaattaaaaacagaattaccatataatctaggaattccacttatggatatatatttagaatcctttttgttttgttttgttttgtttttatgatggagtatcactctgtcgcccaggctggagtgcagtggcacaatctcggctcactgcaagctctgggaaatctctgcctcccaggttcacgccattctcctgtctcagcctcccaggtagctgggactacaggcgtccgccaccatgcctggctagtttttttgtttttttagtagcgatggggtttcaccatgttagccaggatgatcttcatctcctgacctcgtgatctgcccacatcggcctcccaaagtgctgggattacaggcatgagccaccgcgcctggcctagaatactttttaaaaatgagattcaaagatacatttttacatccatcttcataacaatagccaaaagttggaagcaacccaagtgtccattgatggatgaataaacaaactgtgatatatacatataatggaatatcattcagcctcatatatatttcattaagcatataatggactatattattcagtcttataccatggatgattattctgacttatcatattattcaggaaaatgtggtatatacagataatggaatgtattcagcataattctgacatatactacagcgtgaggacctaatgtaagccaggcacaaacagacaaatgtaatatgatttcaatcatatgagttatctagagtagataaattcatagaaacagaaagtaaaacggttgtcaggggtgggggtccaggggagaggagataaggagctgttgtttaatgagtatggttttggttttccaagacgaaaaactgatgatcagttgcatggcaatgtgaatttacttaatactgctaagctgtacacttaaaaatggttaaaatggtagatgttgataagatgtgggcatgggctcaaagaaaagtaagcattcctggtccagattttggctttcagatttgctgaattctgtcttcacagagtcaagggagtcatatcagctaactcagaagagtttatacacaagaaggcaaatttttgagagtctagtatttttttttctgggtagtcctaaatgttaattgcactaaattctcccctggtatataaataaattgagcagataaataatttgcttgtcatatatctaacaagaagtaaggaaatagataattggaaacaatacttcccccatcttaatagagttaaataacaaaaataacgttaattaaaagaactaaatagctaaattatagaatatatttactatcagtcagacattgttgttagtacttacaaatcaatcctcattttacccagtgaagaataagccccatgttgcatacatgttgaacacctattatgtgccctgtcctgttaagtcactggagacatctgtggctacagcaggcagtgataaattctactattttcctcatttttaagagaacaaacctaagcacagggagctattgaactgtggagccactgttggaacccagaaaatcccatttagagtactcagctcttagatgtgctctggtaatatgtcataagaaccagagctgatttctagactctggtccacatttttctttccagcagagccctacctaaataatgagagggtctttctcttctcttcttattcctcttctccactgagaagcttcatttgctcatgccagacatgttttattatgaaattgggcctcatgttacttacatatatatcctagttttgtctttctaagactgtattttcataaacttgaatatatttgtgaaacattttgttcaccccagtaatatatccataggcaactctttgaaaccctacatatttctatccatttatgaaaatgtccacaaggcttcagatttctatctgtttgtcacacacctttgtgtcatcaccaggatataagcatgcgctaaaatcagaactaaaccaaccaaatgaaggctcagagctcagggagggcacatctagaagggctcactaaaggaattagaggtgtggaaatgtaagcacatctggggaagagaggagagcccagtgcattagaggagaaggactgagatgaccgaagactgaatcacctcacttggcagctggttgatgccttttttagggtttgctgctgggttgattgcacattctgactggaggaaccctaatagctaaggaacaatcttttagacagttacattatagatagaattttctgtcttctgaaaaaaattaggaatctaatgaatgatttaaatcaactaaatacataaacaaattttaaaccagtaaggtctagaatcttgaaaatctattcatttttaactttttactttcaaacaattttagatttacaaagaattgcaaagatactataaaattttgcttatgcccttaacccagcttcttctcatgttaacaacatacatgaccatgttgtaatgaatcaaaacaaagaaatgaacattggggccatattactaactttcagattttactaagatttcctcagatttttaaaaactgatgttttatcttatttcaagaatcagtccaaattgattcttgatttggattgatttttgtcaatccaaattgttggattgttgtcataccttcagtctcctccaatctgtaacgcatgctcagtctttctttggctttcatgacattgaaacttttgaagaatattggtcacttatttcatagactgttcaccaatttggatttgtctaatgtttactcaggattatgctgaggttgtatgtttaaagggttgaaaccacagagtttatctgatcgtctcatcacacaatatccaaggtacatgatattgatatcttttattacatatcttttattactgctgatgttaacttaatcacttggttaagatggtgtttgccagacttctgtcctataaagttactatttttgccctctacacactacatggtagaagcatatcactaaatagcagcctacactcaagtctctaatctagtttccctcattcatttttatgttatcttacattcttggtgatatcatgtaattagccattttaggattcacaaatgtttatgatttcctgaagccagtgctctctatcttagaacaactctaaatttaatcaggaaataatgcaagcaataatattaaaatgtataaagggattcttgaacttaggtagctcaatcagaagaattaaatgagttttaaaatatcagaagtaatataagtgtagcagtttgtaagtttagcaaccatattaatacagaaaaaaaaaacagaaaaagttgtattatcagaattaacgagatttacggtagagctgcatctattgttaataacaaagaaaataaaattgcaatagaatgttgtgcaataattgcttgtcactctaacaaaaattaatttggattctcatagcatattaaaaaaactctaatatattacataattaaatgtaaaaacatatttacaagaacagaaactgaatatgtgtaaatcaaaagacttaaggaggcatgtggctctatgttctagacagtgcttggaaaaatatacaaggaactgtttagtgtttggtacacacatgaaataaagaataagtatccatcaaaagattatggctacaatgtgcaggaaatgttttgacaatgattaggaattctaaaattataaatcaataatgtaaataaacaacattgaaactagagtaaatgaaataacaggtaaagtaaaatcaaaattgtaaaacttaattgaaaaaagaatttaaattagcaagtaaatgggttactattgaaatttactaccaggtagtattaattagaataatgataaattacctctcagccaaataaataagcaacattttaaataaaaaatacaattaataggttaaataaatgaaatattaaagatgttcagtacagcatggaataataatgcattgtatacttgaaatttgctaagggagtagatattatatgttctcaccatgcacaataaaatattataactatgttaggtgaaggatgtgttaacttgattgtcagaatcattacaacaaggcataattaaagcaaaacactatgttgtacaccttaaatccataaattttaatttctcaactatatatcaacaaaaaatgtttaaagattttgttcgaattcatctattctttgaaaatgattttcagaaaacactaacaaaatatgcatgaagatcttaacccacattcttctacaagtatcatcttatttccctactccacaaacaagtttcccaccataattttttatgcatagaacacccaaatacccttattgtatttcttcttcaacccactcccatcaagtttctgtcccattcattttactaaacctagatccacctaaggtcactgatggcatctgtttttgagtccgttaggacaggtcagccttcatcttccctgaaaacaccactgtctacccctcgcttgtctctccctcattctttgctatttctccttccagctgcactgaccactcctcctaagtgctctttgaccttcacagactctccttctctgccctaccaatgactgttgaggatctgcaggactaagtttagatcctgtctcatcgttccctcaatttataactatgttaggtgacagattccctaatatccattctcatgtcctcaataccagacatgcagtaaagaatcccaaattaatacctttgcccatggcatttgttgttcattctagacccatattcccagctgccaataagattctggaaatactgtttcccttggtatctgtgggatttttgttctaagactccacacctgtcctccagatacccaaatctgtgaaaactcaagtcctgcagtccccttcatatatgcgagtttcacatcccacaaatgctgtattttctatccagtttagttttacatgcagaaaatacagatatggaaggtgaactgtattggaaaaaaaaaaacctgtataagtggacccatgcagttcagaagttcaatcccatgctgttcaagggctacctgtacatataccccaagtaccttaagaaggacatctaacattgttttccctgcctggcatcatttgtatctaaaacttctggtgtgagaacattgttttcctttacttctttttcaagcttttaagagaattgcaataaagtaagcattagtcctgtttttacatctctttctctgtaagatggagagtgctttattcaatttatttcttgaagggaactctacaatctgccacttacttagcttatacatataatgtgaatggaataaatgagtaaatatattttattgtccttccttcaattatgttaaaaatgtgggtgtggattttgtttttagaaaaaagatttccaggcattttccttaatgaataaaacaaacgagaatttaatgaataaaacaaatgcaaatttaatgacatggaaagacgaatatatttgtaaattttaacacaatgtaaagatgaatatgttattatatgtaaaatatctaaatattataaatgaaacagctgcaaaaagaatggaaataagtaagtatataaaacatatcagggcagtcatgtcttaggaactgaagaccagagccaaaggtttttaacatatacttgcttactattgttaacaaggtatttgctgaatttaattcaataaattctgtgacaactgcagaaaaaagaacctattgaaatgaccaaagacacatgtgcaagtgtgatatggcagattaatcaatgagaataatttcaggatgaacccaggtcttcatccttacttctcagtccttcttgcaagtttgttgatgatgaagagaaggatttcacgattccactctgacaacctcccaagcacagtcactgtatttcttctcctccaggtagattccctggattcccatgcattccctgaaagtacgtcctcaaggccagtgtagggccccaatcaccccacagattcttcctctctttttgtctgccctaagcaagactccaggcattccagctgcagatgaagtccagtgtggagttggtccaggagggtcatgttccaggcagcagaggagcactctgtggggaagaggctgaagatctgctgaagcatctcatggaggacagacagggccggggccttctgcaactgactgccatccacatctccagggggaacctgaagtctcttctgtccttgagacacaagaaagtggagattctgcacatttggcccagaagtgccaaggtgttcctgctaagtaggccatggttctgaggcaggtcccagctcagagatccaacagggccacagtggcaaagcggcagggccacgagtagaggaagcaggaggaccattgggaaacgagggtgctgctggcctagctgagctggggtctggatgaaccttggacttcaggttctctgaaggcattcctgctatgcatggctcttagttggaaaaaaatagctttcagggttggtcaagatggccaacgagaagctgctagtgtgtgccactctcaagtagagaaatggaaggggcaagtacatacagcaccttcaactgaaacatccaggtacacacattgggactcaagaaaacaacttgaccagtggagaacagagtaaagcaaggcaggatgactgcctacccaggagtgacacagagccaggggagcctccccaaccagggaagtggtaagtgagcagccttggggacccacgcttctcccacaaatctttgcaaccctcaggtcaggagatctcctagtgaactcactctaccagggcctccagtctgacatgcggggctgtgtagggtttcagcagagcagccactcagcatacctggggaacctggagccttagatacccaggcttccccacaaaagaagctataactccagccaagcaggaggctagaccgctatacataccccagtgaaaggggtttcatccatggggctgagcagtgacaagtggcaggcccaccttccatggtctgtctcagggtaagacccactggcttgggaatccagccagccactggtagcaccctcacacccccctgacatggagctcccagcggcagggtgtgggctgccatctttactgtttcacagccttagctattggagcctctgggttctagggagtccaaggcagctagggactggagcagccaccctgcacagcccagcagctctacagagaagcagtcagactgcttattcacgtcaatcccaaatcctgtttcttttcaccaggtgaaatctctccactggggtctccagtcacctccaccactgttttctggcagacagcagtttcaaatgtccctgggatggcgctcccaaagggaagggtgggttgccattgatgctgtttagcagccttagccattcttgcaaatgccattcttttgtgctgggggtggtagcagacccccagcacagcacagctgctctaccaaaaagtggccagactgtttcttcacctgattccctgatgctgcttctcctcagtgggcggcatatccccaccggggtctccagccacctcgcgcaggtatgttccagcaggcaacaggttgtacctctctggaacagagctcccagagggaggggcaggcccccatcttcactgtttcgtagccttcactgttgataccttgaggaactgaaaaatgcgaggtgactatggtctggattggacccctagcgtattgcagcagccctgtggaaaagtggtcagactgtgtgttatgttggtccgtgatcccctatctgctcactgggtgggtctgccaggcctggaactgcagccaccagcagggactatcgagccaatagcagctctgcaactccctagaacagagttcccagtgagaagggtgggtttccatctttgctatctcacagctcttgcccttgctgtctccagactctggagagtttgcagggaacagtggctggtccagatccctagcacagagcaactaactcacagaagagtggacagactgttctccatgctgttcctggttgtcacctcgccacaatgtgcagggccacctgaccagagtctccagcacaggcacccttcccctgcctcatctcctcaatcaggcagtccagcatttctccaaggaagaaatcccacagtcaacccacaacccatccaccactactgttgcagtgggacagccccagcagccctctggctggggaaggaacaaagggcctagtcactacactctcacctccagcacatcatagccactgtatgaagaggagtccagcccctcttccctgagaatccccatccctattcttcaggaggcagggcccccagcccatgactgcaaaacagtcaccctacacatggctgagcacatccactggtagttgcctggagtttccctggggagaggctcccagagccatcctacctctgccactgccacagcagcagttttatccatgctgccttgggtctggggaagaaacaaagagtctgaagctctttgtttacaagcttacagcacgccacagtcacctgaacttaaaacacgctgcagttaccatatggtgaggagaatagtctctactcctggtaagattgtcgccttctgtttcccaaaatgtgaagccccaagcttacaccagcagtgcagccaccccacccctctggctaaacactcccattaacatggcttcacatttctagaaggtggagaccccaggggcaacagaaagcctgtctaccactgcctctgcagtggtactaccccagctaccttggaacttatgaaggagcagagaccccaagtgccttatccatacctccaacaagctgcagtcaacccaagagaagaggccagtctgtctcccattggtcaaccacccacccgtcacatcaccaggcagggaacccctgtcttgggcccacagcacagacacccccattccaggctgaaagcactgaatgattgctcacctgcatctctggggtggagcccccaggagacaagcaaaagaccctcagttaaaactactactaaggtctcttccttccatgcctccaaggtgaggagaaaacattaaccctgagatcaccccagaactgttgtgtgcagcctggtagtgccaagacaaaagctacagtcagcagtcaagtgggagaggagcccacactttcatagcattgagacggagcaggctgcaaccatgaggaaatgtatgggagccacatgactgagcaagagcctgacaactgaccactgcacctaagagtcacctactaggtcatgcccaaagcttcaacactaaaaaaatctcactaacataccctcattaaaccaaagacaagtcagctacaaataaagaccctacacaaagctgcagccctgtgaacacagccagaaccaaagtcaatttattgattggactcaagctacactcccatatgcagagatgagaaagaaccaatggaagaactatggtaactgaaatggacagagcatcttatgtcctccaaataatcacactagttctccagcaagggttcttaaccaaaatgagttagctaaaatgacagaaatataattcagaatatggacagaaaggaatttcactgagattcaggaaaacagtaaaacctaaaccaaggaaactaagaatcacaatcaaaggagagaggagctgacagacaaaataaccagtatgaaaaagaacctaacagaactagtagatgtacacactacaagaatttcacaatgcaatcacaagtattaacagcagaatagaccaagctgaggacagaatctcaggtcttgaagactggctctctgaaataagacagtcagacaaaaataaagaaaaaagaatgaagagcaatgaacaaaacatccaagaaataggggatggtataaacaggccaaatctaggaatcacttgcatcctttaaagagacagggagaaaacaaacaacttggaaaatgtatttcaggatatcatctatgaaaactaccacaaccttgatagagagaccaaaagtcaaagtcccttgaagttctacacccagattgaccagctgttctgattcctagtctagcacaatccatagaggaagggataagttaggaggtcccggggaggctgggcaggctggaggaaagggacatatcctgaacctttctctttccccatagctgtccattgccccaagacatgtcatgcctgaagctgggagtattttctctgtctaagatacaaaagttaaggaaatgggctaattccagtactgtgatagttctttcttgggaagagcctctttttagctatgaagataaatctcctgccagcaggcctacttctgcattcacaacctgctctccacagacttggctgctgtcttggtgcactttgaccagttgggggctctctttccctgtaaatgttgtaatagtctcaaagtcaaatggagtctgccttttatttccttttttgctaagctactgttatgtcattgtaacagtgacattccgtcttttacagaaatattcatcataagaaaggaaaaagtattttataaaagagcttctgaaaaacgtagaactttcactggccttctgctttaatttgtgattttgtgctcttaaggggaaagtgatgggtaaaacccacaagagaactgaaaacagctgtatgaagaggcagtgcaggctaatgatgagtgaagaagagagcacagtgtgcatttctagaggaagaggaaggaaactaatgtgatatgggagtgaaaaacgggacacagaaaagcagggaggaaaggggaaagtgtgtcagctctcagaaccagcaaagatgtatattttacttaagtttagtagactaacttcatatgggagtgtactctgggattctgagagccaggaaacaaatgttccaggtgccagaatcagttaaccatcgacacgtgtattctgcacttcaatctagatgctgctcctctgacaggtatttatacaagccaccattcctgactgaatataaataggactttgaaatgaggtgagacaatttttcagcctctctagaattcatgacagaattctgttgttttaggctgcctaaaaaaatatatgcaagcagaatggaatttcaatgtaaaataatttattgttatttatacctggtgtgtaaattttgtattgagatttccttaataattattaatctccttttttcctcaattatacacaactatctcctgctatctgaatttccttggttcatgttgtattttcagctgattttgaccaactttctctctctctccttcctttctttgtctttcttttctttccttccttccttcctttttctttctctcctttctttctttctctctttctttctctctctctttctttctttctttctttctttctttctttctttcttccttccttccttccttccttcctttccttccttccttccttccttccttccttccttccttccttccttccttccttccttccttccttctttctttctctttctttctttctctttctctctcttactttctttttttttgattttgctttaagttccggaatacatgtgcagaccgtgaagatttgttacctaggtatatgtgtgccatagtggtttgctgcacctatcaactcgtcacctaggttttaagcacaaatttttttttaatccagtctgtcactgatgggcatttgggttggtttcctgtctttgctattgtaaatagtgttgtaataaacatacacctgcatgtatttttataatagaatgatttatattcctttgggtatatactcaggaatgggattgctgggtcaaatggtatttctggttctagatccttgatgaatcgccacactgtcttccacaatggttgaactaatttacattcccaccaacagtgtaaaagctttcctgtttttccacagcttcaccagcatctgttgtttcctgactttttagtaatcacccttctgagtggcatgagatggtatctcattgcggttttgatttgcatttctctaatgatcggtgatgttgagcttttttcatgtttattggccgcataaacgtctgcttttgagaagtgtctgttcatgtcctttgcccacttttcgatggggctttttttttgtgtgaatttgtttaagttctttgtacattctggatattagacctctgtcaattgggtagacggcaaaaattttctcccattctgtaagttgcctgttcaccctgatgattgatagtttcttttgctgtgcagaagctctttaattagatgccatttgtcaattttagctttggttgcagttgcttttggcaatttcatcataaaatctttgcccatgccaatgtcctgaatgctattgcctacattttcctctagggtttttatggttttgggatttacatttaagtgtttaatcagtcttgagttaatttttgtataaggtgtaaggaaggggtccagtgtcagtttcctgcatatggttttccagttttcccagcaccatttattaaataaggaatcccttccccattcctaaagtattgagaaagagattctcttttccagtttctgattttattttatgaaacaaatgtgtcagtttttactgacatttaacggaatattaatcaaaataatgatcaattactattgtaaattttatattttatgtgtttaatatataaaatattaaatgtattaatatgatttaccagtgcatcacatttatgaaatttattcattgacatgtattttcaaaaaggaaacactatgcagataaaagataatccacatttttgggtgtaccaacttattacttccctccattgcaaaggcagatatctcacaattttctatatgtgttatcttgatttttcttttttgattcactcttctacttaccgcagtatggcttctgctgattaattctatcaatccagctctcagtaagctctgcattgccctctattttcttgctatagtgctcagttttaattcacattttccataagtctattgattctttttctaagcacatttattttctaaatcaacttttatcaccattccctctcatccttctaaagttaaggtattccacctctgttttctttgtgtctcttctgttcccacactttaatggtggaaggtcctcagaatccagtttaagtctttttttccctctccacttcctccccacatgacagccttcattttaggcctttccattgccagttatgaatgtccagatattgtattccttggaaactgcaaattcacatatctgacttgcaatgtacattttcaattacatgttgaagtcagtttacagagaatatctgtgcttttatttccagatatgtctcaatctacattctgctaagaggaattcattgtttttttacttcctcacattatagcagttagcatcactgatattaattcagcattattattgtttttagatttctttcctgacaaaaataaaagatacaagagaagagggactgtatattttatgttcacatttatatcctgaaggcaacatataaccaggtacagaaaaatatgtttttttataacttgaataaaattatgataggtaacttaattaaatcatctatttttaagtcaggttgtaaagtcagccttggcattttatcttaaggaataaacaaacacaagaaattttgtatagtaaaaatttaatgaaaaaggaaattaatatattggctaaatatgaagaacatatattgttacattcaccacaatgtaaaggtactcatgatatcacataaaaaataatttaaattttaaaaataaataaatatttaaataaatagatgaacagagacatcagcattgtcatctgtaaaggactagtgcctgcacaggtatacaccaagcttcttcacactgctgaaaacatttgaaaattttgattcaactcgtggtggttatagaagtgagtctttgaaatggaagaactcatgaaagtgtgagataatgtattagtcaatcaggatcatttccatgttgaaccaggtttcaatccttcctccttaatcttttttgcaagtttgttgaaaacgagagggatctcatgatttctgctctgacaacctcccaggcacaagggctgtatttcttctctgttagataaagagtgattctttggaagtatttcctcacagccaggatggagtcctcattcatcaggggagtctcttccaccccaacctcctgtatcacacatgcttccaggtcattcagttgctggtaaagttcagtggaaaatttttctaggaggctctgttcccaagcagcagatgagtcctctgtgctgaagagattgaaggtctgctggatcatctcatggaggacagagatggcttgagccttctggaactggtggccatcaaactcctcctcggggaatccgaaatcatgtctgtccttcaggcaggagaaatgagagattcttcccatttgtgccaggagtatcaaggccctcctattacccaggctgtgggtctgaggcagatcacagcccagagaacagatggatttgtagctgagcaccagcacggccatcagtaaagaaaaggacagggccattgggatgttgcaaatattgctaggctacttgagatggataaccttgaacttcggcctctaggttttctgaagactttgctctgtgcataggtcttaaatagtgaacatactaatttccattttctaaattccctagttgtactttctatctctgtttttgctttctttatgcactctctacatgtgtttaaaaagtttttcattttttttcatcattgcctatttttcacctgcactcaaaggcttttatggtatttttttctaattgaaatcttcatgaaattttaataacacagatttggcatatctatttatgtatattacgtatacctctacttcacagataaaaactacaaagtttgctctttttattcaaagtaaagaatgacagaaaagttaaactaaaatttaagtttaaaagctattgacatttaacttaatttgataagtatatttgtggaataacttttagtgtaatttgttcatgtaaattttgtatcaaagtacatatgcaaaataaaaatctatatagatacacattaataatatgaatataattacatatccaatcattcaaaactcctaaaaatatgaatgaataattttttaaaatttttctcttagtgtatgaagctttgaattttgctttatatgacaaaataatttgtaaacttcaccagctgcagtattcatccagatgttgccaacacttttttcttttcagcacttgacataaatattgatgtgttgaataactttactagaaataaatcatataatataagctatttgcattgaattctcaaagtctacaaaacatcttgaagaactgaggatcaaacataagtaagaaccataagatagtcaatggcagcccaaagatatgcaggttaaagccacatattgtgataagaccttaagatccagcaaaaaatggacaaaaagtcctccaatcacagtcatctatttgccataggtttgtaacactggtcttacaaatattttgtttatcttcatgaactcaataccagtgcttctcatatcatacacaaaaaaacccaatgagaaagatatatattaagcaatgaaattttgttggatagaattgttggagagtcacaaactattgtaatatgtcagatttgtttacactacgagaactaattttcgtacccttagaagaagtgtcattccaataaacatatgtgacttagaaaatattatgaattaaattatttttggcatttttcattgaagttcatattccctaaaggttttcagaagttcctatccaagtcaattcttatcaaataaaaaagaccatctttgttgtaaattcataaatttataattattgaatattatcatgtaaagaattaactttcagagtgatcctgaactctggctctacctttttgttgttttttttttttttgcataagaagtttttttttgcataagtaggccctatagatactgagtccttaaatggaatgaggtctgttttagcaaatcagctatttagtaagtggagtttttactagtttctcattttttcttctactggaaagtgttcaagaatgaagctattttgcttcctcatggccatatttgctgggattgtaatagacaatcacaaaaatttccattcagtgtttactgagagtcagtaatgcccatttagtttactgctaaaaccactgggattctagttttttttaagtgcatgtagatctggggattcaagttgcaagagcagcataatatcatcctttgcctagcactatattaactatttatgacttcatctctaatctgtcctctactttgttataatagaaaataactagcctggtgtcaaatgcagagtcacatatctaaattcaaactctccaattcacacagtttataggagtcagacaatttgctattcccaaaagtatggaataatagcctctcttccccaaataatcctacagctttccttccctggatcaaatcccgagaatgtgtatgtgaactgtgaagacttgtgacatcatttttccatcatttataaatttcagctttaaatcatgtgataatcttttaatgacacgggtagaaaatgagccggtttatataaggtagaaattatgaaatggatcaattttagaaaataaccaaacacattttattattcattattttaaataattcatttaaattctttatatcattgaacaattaaaatattctacattgtgaaatgtgcacaggggtttccataaataggagctttcatttcagaaatgtatattttgtacattgatttagttgttgatccagtcaacacatttttattgaattttgggctcatccttttattagaccctgagaatacagggcaattttgcccaagttattattcttagtctttgaaacactgggggagagagtatttttttctttgttcgcttgagagtgtattgggaatttttgcatattcatttttcatgttgtattttactgtgaaaattggtttttctatactttgatttctttcattttcacattcaggttagtgtcaatgaaagaatacaaatataatttttaaatggactatacaatggttctatgtggtattcacaacagcaaatatatttatatttctcacttcacttttcctagaaagtaaaagtggtctgatttttcatcttaatttatgggaacaaaaagaaaacaaatgtatgtctaaatgtgataaacatgtaagaggagaaatacttaatgcaaatgacaagttaatgggtacagcaaaccaacatggcacatgtatacctatgtaccaaacttgcccgttgagcacatttaccctggaacttaaagtatagtacaaaaaaaaaaaatgaccagaggggaacttagaaaatatcttgagaccgatgaaaatgaaaacacaacataccaagacgtatgtgatgcagtgaaaacagagctaaaggggaaattgaaagctgtaaaagcttatattaaaaaagaagaaagacctcaaaccaatgaactactttacaagttaaggaactagaaaaagaagaaataaacacatagtaaggaagaggaagaaaataagaaagactaaagcagaccccaggtcttcatccttacttctcagtccttgcaagtctgttgatgaagagaaggatttcatgattccattctgacaacctcctaagcacagtcactgtatttcttctctttcaggtagattctctggattcccatggattccctggaagtacctcctcaaggccagtatagggccccaatcacccccacagattcttcctctcctgttgcctgccctaagcaagactccaggcattcgagctgctgatgaaatccagtgtggagctggtccaggagggtcatgttccaggcagcagaggagcgctctgtggggaagaggctgaagatctgctgaagcatctcatggaggacagacacagcctgggccttctgcaaatgactgccatccacatctccagggggaacctgaagtctcttctgtccttgagacacaagaaagtggagattctgcacatttggcccagaagtgccaaggtgttcctgctaagtaggccacggttctgaggcagttcaaagcccagagatccaacagggccacagtggcaaagcagcagggccaccagtagaacaagcagtaggaccattgggaaacgagggtgctgctggcctagctgagctggggtcgggatgaaccccgcactccaggttctctcaaggcattctttttatgcatggcttatagctggaaacaaatagttttcaggattggccaagatggccgactggaacctgctagtgtgtgccactctcatggagagaaatggaaggggcaagtaaatacagcaccttcaactgaaacaaccgggtgcacacattgagactcaagaaaacaacttgacccatggagaataaagcaaagtaaggcaggacaactgcccccccaggagtgacacagagccaggggagcctctcctgcccagggaagtggtgagtaagtgagcagccctggggacccacgcttctcccacagatctttgcaatcctcaggtcaggagatctcctagtgaacccactctaccagggcgtttagtctgacatgcagggctacgtagggtttcagcagagcagccactctcgcatgcatgggtaccctggagccttagatacccaggcctccccacaaaagaagctataactccagccaagcaggacgctagacccctatacatacccctaggaaaggggtttcatccagggcgctgggcagtgacaagtgacaggcccaccttccatggcctgtctcagggtaagacccactgacttgggaatccagccagacactggtagcagcctcatacctccctgacatggagctccctgcggcagggggtgggctgccatctttgctctttcacaatcttagctattggagcctttgggttctcgggagtccaaggcagctagggactggagcagccacccagcacagtccagcagctctacggggaagcagtcagattggttattcatgtcgatcccaaatcctgtttcttttcaccgggtgaaatctccccactggggtctccagtcacctccaccactgttttctagtggccagcagtttcgaatatccctgggatggcgctcccaaagggaatggtaggttgccattgttgctgtttagcagccttagccattcttgcaaatgccattcttttgtgctgggggtggtagcagacccccagcacagcacagctgctctaccaaaaagtggccagactgtttcttcacctgattccctgatgctgcttctcctcagtgggagggatatccccaccggggtctccagccacctcctgcatgtatgttgccggaggcaacaggttgtacctctctggaacagagctcccagagggaggggcaggtccccatcttcactgtttcatagccttcactgttgatatcttcaggtactgaaaaatgtgaggtgactatggtctggattggacccccagcatattgcagcagccctatggaaaagtggccagactgtgtgttatgtgggtccctaatcccctatctgctcactgggtgggtctgccaggcctgggtctgcagctaccagctggggctattgagccaatggcagctctgcatctccctggaacagagctcccagtgagaagggtgggttgctatctttgctttctcacagctcttgcccttgctgtctccaggctctggggagtctgtagggaacagcggctgctccagatccccaaaacagagcaactgcctcacagaagagtggccacactgttctccacgcagttcctggttgtcacctctcctctgtgggcagagccacctgaccagagactccagcacaggcattcttcccttgcctcgtctcctcaatcaggcagtccagcatttctccaagaaagaaatcccacagtcaacccataacccatccaccatgaccgttgcagtgggacagccccagcagccctccggctggggaaggaacaaaggcctattcactacactggcacctccagcacatcatcaccactgtatgaagaggagtccagcccctcttccctgagaatccctgtccctattcttcaggaggcagggccccctgcccatgactgcagaacagtcaccctacccatggctgagcatatccactggtagttgactagagtttccctggggagaggctcccacaaccatcctacctctgccactgccacagcagcagttttatccttgctgccttgggtctggggaagagacaaagagtctgaagctctttgtttacaagcttacatcatgccacagtcacctgaacttccagcacactgcagttaccacatagtgaggagaacagtctcctcctggtaagttttccacctcctgtttcccaagaagtgaagtcccatacttacaccagcagtgcagccaccccactcctctggctaaacactcccattaacatgacttcacatttctaggaggtggagaccccaggggtaacagaaagcctgtctaacactgcctctgcagtggtactaccccagctaccttggaactaatgaaggagcaagaccccaagtgccttatgcatacctccaacaagctgctgtcaacccaagagaggaggccagtctgtctgccattggtcaaccatccacccctcacatcaccaggcagggaacccctgtcttgggcccacagcacagacacccccatccgaagctgaatgctctgagtgattgctcacctgcatctctggggtggagcccccaggggacaagcaaaagaccctcagttacaactactactaaggtcccttccttcaatgcctccaagtcggggagaaaacattaaccctgagatcacctcagagctgttatgtacagcctgggagtgccaagatacaagctacagtcagcactccagtgggagaggagcccacactttcatagcattgagaaggagcacggctgcaaacgtggggaaatacaggggagccacgtgactgagcaagagccttacaactgaccactccaactaagagtcacctactaggtcatgcccaaagcatgacactaaaaaatgtcactaacataccctcattaaaccaaagacaagtcagcttcaaataaagaccctgcacaaagctgcagccctgtgaacacatccagaactgaagtctacttattgattgaactcaagctacattcccatatgtagagacgagaaagaaccaactgaagaactatagtatctcaaaaggacaaagtatcttatgtcctccaaataatctcactagttctccaacaggggtacttaaccataatgagttagctaaaatgacagaaacataattcagaataggatagaaaggaatttcattgagattcaggaaaatgataaaacctaaaccaaggaaactaagaatcacgatcaaaggagagaggagtggactgacaaaatagccagtatgaaaaagaacctaacggacctagtataggtacactactagaagaatttcacaatgcaatcacaagtattaacagcagaatagaccaagctgaggacagaatctcaggacttgaagactggctctctgaaataagacagtcagacaaacataaagaaaaaagaatgaagagcaatgaacaaaagctccaagaaataggggattgtataaagaggccaaatctaagagtcacttgcatcctttaaaaagacggagaaagcaaacaacttggaaaatatatttcaggatatcatctatgaaaactaccacaaccttgatagagagaccaaaagtcaaattcccttgaagttctacacccagattgaccggctgttctcattcctagtctagcacaatccatagaggaagggataagttaggaggccccggggaggctgggcaggctggaggaaagggacacatcctgaccctttgtctttccccatagctgtccattgccccaagacgacatgtcatgcctgaagctgggagtattttctctctccatgatacagaagttaaggaaatgggctaattccagtactggggtcagttctttcttgggaagagcctctttttagctatgaagataaatctcctgccaggaggcctgcttctgcattaataacctgctctccacagacttggctgctgtcttggtgcactttgaccagttgggggctctctttccctgtaaatgttgtaagagtctcaaagtaaaacggaacctgccttttatttccttttttgctaagctactgttatgtcactgtaacagcgacattccctcttttacagaaatattcatcataagaaaggaaaaagagtattttataaaagagcttctgaaaaacctagaactttcactgaacttctgctttaatttgtgattttgtgctcttaaggggaaagtgatgggtaaaacccacaagagaactgaaaacagctgtatgaagaggcagtgcaggctaatgatgagtgaagaagagagcacagtgcgcatttctagaggaagaggaaggaaactagtgtgatatgggagtggaaaatgggatacagaaaagcagggaggagaggggaaagtgtgtcagctctcagaaccagcaaagatgtatactttacttaagtttaggagactaacttcatatgggagtgtactctggaattctgagagccaggaaacaaatgttccaggtgccagaatcagttaaccatcgacacgtgtattctgcccttcaatctagatgctgctcctctgacaggtatttatacaagccaccattccagactaagtaggactttgaaatgagttgagacaatttttcagcctctctacaattcatgacagaattctgttgttttacgctgcctaaaaacaatatatacaagcagtatggaatttcaatgtaaaataagttattattatttataccagatgtgtaaattttgtgtgaggatttccttaataattattaatctccttttttcctcatttatacacaaccatctcctgctctctgaatttccttggttcatgttgtattttcggctgattttgaccaactttctttctttttaaattttgctttaagttccgggatacatgtgcagaacgtgcagatttgtttcataggtatacgtgtgccatggtggtttgcctcacctatcaactcgtcacctaggtttttttttttgaattaatttcgtatttattttattttaaccatcctttctcctccattacagtatacatttcatgaagacaggaattccatgttattctatttcctataattgatgcttaatacctattgtcaactgattcttttctctgtgcaattcctctggagaaatattttgttctgtgccaagaaacagtttcattcaacggttaaggtgacttgtgtcactgatctgatttccttcttttacattaactatcaaaaatctcagacttattaataaagacatgtcttcatagggtacatctttataatggtcttatttttattttattttcctccctcttttttttcattttactttattctgtcctaaacatttaaagtttcagctaattttaaagtaaaagatgctcaatgggaaaagctcacacaaatcagagctacctaaaagtagagttggaaagtcccaaggatctttttctctgaggcaagcctctttgcttctgagtgcttgccctgcagactggcttatgaagaggtcaccatcttttcagattccaggggcccgtaatgttcataccactgcagtattcttactacacactgtaataatctggaataataagatcgtaggcactctttcttgccctcacatgtggatctgccttctccttttaaacagccatgtaacgttccctatctcacctactttgaatttttatattcttgctgctctaaggtttttttttggagcaaggaaagcaattaaaaaaaataaaatttactttcaaaagaagagtagagataattaaccagcccttgccacctaactaaatataattccctagtaactcctcttggagccaccaggttccctgggagtggaattgcctgtggaaaggcctatgtggattctgagcttgggaaatggtgacggagccctctctctagcctctcagcctggccaaacacggtgaaacccgtctctactaaaagtacaaaaattagctgagtatggtggcacgagtctgtaatcccagctactcgggaggctgaggcatgagaattgtttgaatccgggaggcagaggttgcagtgagccgagatagcaccgctgcactccagcctgggtgacagagcgagactctgtgtcaaaaaaaaaaaaagaaaaaaaaaaagtaagaaatgagtgaacatttcaaaatggcaggaactggttaagtttaaaactgaaaactttcattctgacaagaaagcagtcattccttttctccattaacagagataaagaaaagcttttcaaatctgtatatggctacgttgattgacgtccgagttaaaaatgaaatgtcggccgggcgcggtggctcacacctgtaatcccaccactttgggaggccgaggtgggtggatcatgaggtcaggagatggaggccatcctagctaacatggtgaaaccccatctctactaaaaatacaaaaaattagctgggcatggtggcatgcacctgtagtcccatctactcaggaggctgacacaggagaatcactggaacccaggaggcggaagttgcagtgagccgagattgcgccactgcactgtagcctggttgacagagcgagactctatctccaaaaaaaaaaaaaaaaaagagacagagagagagaaatctcatttccctgttgctcagtcacattcctataaacatactacttgcatgcctggacagttatcaccttccaacctcttatctcggtgatttcccaagctacagagtaagataggtggagaatttttgtacttttagtagagacagggtttcaccatgttggtcaggctggtcttgaactctagcctacacaacagagcaagactccgtctcaaaaaaaaaaaaaaaataggcagagaaggggttatttacatttcacagatgaggttcacaggccctgagttatttttgctacagtcaacgtgaacaataaaaacagcaattgtgccctctggtttgaagagacctggctccacccacctggtggggaaaactacgcctccaccctggtcccatgcctgccagctctcacctggactcctctgttgtctcacgtaagtcacatctaagtatgacctcagctgctcaaaggactgctgagaaagttagtcaagttatccaaccaacactcagcaaactgaggacccatctgggaggtggagccaccctacccaatcacagctgttgggagtgtatctgtctcagtgggtggcacagctgagctcctacctagaggtggccaccatgctaggaagcaccttcgccttggacagtgggctcaggttctggctctgccacttattagctatgcagtcttgggcaagtgactttacccctcctcactgcagcttcttcattgtaaaatgagaatacagacaccagaagctacccatgtttgttggtaagtgcaaatgaggcagcctatgtaaacaagagccagtgtcttcgtgcggcaaaccccatggcaagttctcatggaatattagctattactgctgtgtctagtctatgtaaactcactgccctgccccagccaccagccaccacccaggaacagcatggtgcccggtgcagagtaactgctaaatgctaagttagtatactcacaatgtacctaactccctgatgaccctgaaggaggtgcacaattcttcccggaggaggccctgccctggcttagggctggctctgctatgagggagatagctgccccatctaaagctgctcttacaccttcctggactgtccagaaaaactctctatggtttgctacagacagaacagtcagaaggcgaaagagggcccagatccccaggcgctatcttaccccaactcccttcattgctaaggctaagaatgtctgtgggtcagtggagaacaggcagcattcatctcatcagagaaactactctttcatgcgaacgtctccaatgtatggacaccattttcccactgagtgtgctgacaccatagaaacacggatctgtctttctaagtaaatatatgaatagaagctttaaaatattttaagtacggagtctataattaagacacagtgtttgagatatttacacagaagattaatgactccatgcacataattcatcattgctttagtattaccaagtaatattaagttaattaagagacattgggaggccaaaaaaccaggcacgacccaactgcagccctgccatggaaatgaatgaacaagtcagcaggcagaactgagaatcgggagacccacacggagctgaggagtatctaagaaaccaatgtcacttgcactgacctggtcttgccagttcaaggtcactctcatccgtcacctaggttttaagtacaattttttttaatccagtctatcattgatgggcacttgggttggttttgtgtctttgctattgtaaacatgctgcaataaacatacacgtgcgtgtattttataacagaacgatttatattcctttgggtatatactcagtaatgagattgctgggtcaaatggtatttctggttctagaaccttgatgaatcgccacactgtcttccacaatggttgaagtaatttacattcccacaaacagtgtaaaagatttcctatttttccacagcttcaccagcatctgttgattttgactctttaataattgccattctgagtggcatgagatggtatttcattgtggttttgatttgcatttctctaatgatcagtgatgttgagttttttaatgattattggtcgcataaatgtctactttcgagaagattctgttcatatccttcacccactttttgatggggctttttgtttttgtaaatttgtttaagttctttgtacattctggatattagacctgtgtgagttgggtagactgcaaaaattttctcccattctatgggttgcctgttcactctgatgataggtagtttcttttgctgtgcagaagttctctaattaaatgccatttgtcaatttaacttttgttgcagttgcttttggcgatttcttcataaaatctttgcccatcctgtgtcctatgttttcttctagggtttttatggtttttggttttacatttaagtctttaatccatcttgagttaatttttgtataaggtgtaaggaagtggtccaggttcaattttctgcctatggctatccagttttcccagcaccatttatcatcattccctccaaatacacttttatcatcattccctctcgtccttctaatgataaggtattccacctctgttttctttgtgtgtcttctgttcccccactttaatagtggaagttcctcagaatccagtttaagtcttttttccctctctgcttgctccccacatgacagccttcatttttggcgtttccattgcttagttatgaacttccagatatcatattccttggaaactgcaaactcatatatctgacttgcaatgtacattttcaattacatgttgaaagtcagtttatagagagtacctctacttttatttgcagacatttcttaatctatgttctgctaagaggaattcatttttttttacttcctcacattacagcagttagtataaccgatattaattcagcattattattgtttttagatttctttcctgacaaaaatcaaagatacaagagaacaagaactgtattttttatgttcacgtttatatcatgaaggcaacagataacctggtatagaaaaatatatttttctataacttgaataaaattatgataggtaacttacttaaatcatctatttttaagtcaggttatacagtcaggcttggcatttaatcttaaaaaataaacaaacacaagaaattttgtatagtaaaaatttaatgaaaaaggaaattaatatattggctaaatatgaagaacatatttgttacattaaccacaatgtaaaggtacatatgatattacataaaaaataatttaaataataaaaatagttaaataaataaatatttaaataaatagatgaaaggagacatcagaatggtcatctgtaaaggactagtgcctgcacaggtaaacacgatgcttcttaacactcctgaaaacatttggaaattttgattcaacttgtggtggttatagaagtgagtctttgaaatggaagaactcatgaaagtgtgagatgatgcattagtcaatgagaatcatttccatgatgaaccagttttcaatccttcctccttaatccttttttcaagtttgttgaaaaagagaaggatctcatgatttctgctctgacaacctcccaggcacaagggctgtatttcttctccattagataaagagtgattctttggaagtatttcctcacagccaggatgaagtcctcattcatcaggggagtctcttccaccccaacctcctgtatcacacatgcttccaggtcattcagttgctggtaaagttcagtggaaaatttttctaggaggctctgttcccaagcagcagatgagtcctctgtgctgaagagattgaaggtctgctggatcatctcatggaggacagagatggcttgagtcttctggaactggtggccatcaaactcctcctctgggaatctgaattcatgtctgtccttcaagcaggagaaaggagagattcttcccatttgtgccaggagtatcaaggccctcctattacgcaggctgtgggtctgaggcagatcacagcccagagagcagatggatttgtagctgagtaccagcacgaccatcagtaaagaaaaggaccgggccattgggattttgcaaatatcactaggctacctgaggtgggtaacttgaaccgtggcctctaggttttctggagactttgctctgtgcataggtcttaaatagtgaacatactaatttccattttctaaatgccctagttttactttctatctctgtttttgctttctttatgtactctctccatgtgtttaaagacgtttttcattttttttttcatcattgcctgtttttcccctgcactcaaagccttttatggtatttttttctaattgaaatgttcatgaaattttaataacacagatttggcatatctatttaggtattctacatatacctctacttcacagataaaaagtatgaagtttgctctttttattcaaagtaagttaagaatgacagaaaagttaaactaaaatctaagtttaaaagctattaaaatctaagtttaattagataagtatatttgtggaataacttttaatgtaatttgttcatgtaaattttgttgtttcaaattacatatgcaaaataaaaatctgtataatacacattaatatgaatgtaattacatacctaatcattcaaaactgctagaaatatgaatcaattttaaaaaaattttctcatagtatatgaagctttgaattttgctttatatgagaaaataatttgtaaacttcactagctgcagtattcatccagatattgccaacacttttttcttttcagcacttgacataagtactgatgtgttgaataacttttgtagaaataaatcatataatataggctatttgcattgaattctcaaagtgtacaaaacatcctgaagaactgaggatcaaacataactaataaccataagatagtcaatggcagcacaaaggtaggcaggttaaagccacatattgtggtaagacttcaagatccagcaaaaaaattgacaaaaagtcctccaatcacagtcatctatttgccataggtttgtaacgttgatcttgcaaatattttgtttatcatcatgaactcaataccagtgcttctcatatcatacacaagaaaacccaacgagaaagatgtatattaagcaatgaaattttgttggatagagttcttggagagttacaaacttttgcaatatgtcagatttgtttacactacgagaactaatttttgtacccttagaagaagtatcattccaataaacatatgtgacttagaaaatattatcaattaaatcatttttggcatttttcattgaagttcatattccctaaaggttttcagaagttcctatccaagtcaattcttatcaaatataaaagaccatctttgttctaaattcataaatttataaatattgaatattattatgtaaggaattaactttcagagtggtcctgaactctggcaaagttagtttgcctcggccctatagatactgagtccttaaatggaatgaggtctgttttagcaaatcagctatttagtaggtggagtttttcctagtttctcattttttcttctaatggaaggtgttcaagaatgaagctgtttttcttcatcatggccatatttgggattgtaatagacaatgacaaaaatttccattcagcttttagtgaaaatcagtaatgcccatttagtttactgctaaaaccactggggttctagttttttaaggtgcatgtagatctggggattcaagttgcaagagcagcataatatcatcctttgcctggcactatattaactatttatgacttcatctctaatcctccctctactttgttataatagaaaataaatagcctggtgtcaaatacagagtcacatattgaaattcaaactctccaattcacacagtttgtaggaatcagacaatttactattcccaaaagtagggaataatagtctctgtcccccaaataatcctacagcttcagtaggattaaaaaaattgaagcacaatttttttaatccattctatcattgatgggcatttgggttggtttcctgtctttgctattgtaaatagtgttgcaataaacatacacgtccatgtatttttataatagaattatttgtattcctttgggtatatactcaggaataggattgctgggtctaatggtatttctggttctaaatccttgatgaatcgccacactgtcttccacaatggttgaagtaatttacattcctaccaacagtgtaaaagctttcctatttttccacagcttcaccagcatctgttgtttcctgactttttagtaattgccattctgagtgacatgagatggcatctcattgcagttttgattttcatttctctaatgatcagtgatgttgagcttttttcatgtttattggccacataaatgtctacttttgagaagtgtctgttcatgtcctttgcccacttttcgatggggcttttttttttttgtgaatttgtttaagttctttgtccattctggatattagacctctgtcaattgggtaggctgtaaaaattttctcccattctgtaagttgcctgttcaccatgatgattgacagtttcttttgctgtgcagaatctctttaattagatgccatttgtcaattttagctttggttgcagttgcttttggcgatttcatcataaaatctttgcccatgccgatgtcctgaatgctattgcctacgttttcttctagggtttttatggttttgggttttacatttaagtgtttaatccatcttgcattaatttttgtataaggtgtaaggaaggggtccagtttcagttctctgcatatggctatccagttttcccagcaccatttattaaagagggaatcctttccccattcctaaagtactcagaaagagattatcttttccagtttccaattttattttatgaaaaaatgtgtcagtttttactgacatttaacagagtattaatcaaaataatgatcaattactattgtaaataattttacattttatgctttaaatatataaattattaaatgtattaatatgattcaccaatgcatcacaattatgaaatttattcagtgacatatattttcaaaaaggaaacactatgcagataaaagataatccacatttttgggggtccaaacttattacttgccaccattgcaaaggcagttttctcacattttctgtatgtgttatcttgatttctcttttctgagtcactcttctgtctaccccagtatggcttctgctgattaattctatgaatccagctctcagtaagctctgcattgccatctattttcttgctgtagtgctcagttttaattcacattttccataagtttattgattccttttctaagcacatttattttctaaatacacttttatcaccattccctcttgtccttctaatgttaaggtattccacctctgtttcctttgtgtctcttctgttcccacactttaatggtggaagatcctcagaatccagtttaagtctttttttccctctccacttgctccccatatgacagccttcatttgcgtcctttccattgccagttatgaacttccagatatcgtattccttggaaactgcaaattcacatatctgacttgcaatgtacattttcaattacatgttgaagtcagtttacagagaatatctctgcttttatttccagatatgtctcaatctacattctgctaagaggaattcattgtttttttacttcctcacattatagcagttagcatcactgatattaattcagcattattattgtttttagatttctttcctgaaaaaatcaaagatacaagagaacagggactgtatattttatgttcacgtttatatcctgaaggcaacatataaccaggtacagaaaaaaatatatttttataacttgaataaaattatgataggtaacataattaaatcatctatttttaagtcaggttgtaaagtcagccttggcattttatcttaaagaataaacaaacacaagaaattttgtatagtaaaaatttaatgaaaaaggaaattaatatattggctaaatatgaagaacatatattgttacattaaccacaatgtaaagcgactcatgatattacataaattttaaaaataattaaataaatatttaaacaaaagatgaacagagacatcagaatggtcatctgtaaaggactagtgcctgcacaggtatacacgacacttctttacactgctgaaaacatttgaaaattttgattcaacgcgtcgtggttatagaagtgagtctttgaaatggaagaactcatgaaagtgtgagataatgtattagtcaatcaggatcattgccatgttgaaccagttttcaatccttcctccttaatcttttttgcaagtttgttgaaaacgagagggatctcatgatttctgctctgacaacctcccaggcacaagggctgtatttcctctctattagataaagagtgattctttggaagtatttcctcacagccaggatggagtcctcattcatcaggggagtctcttccaccccaacctcctgtatcacacatgcttccaggtcattcagttgctggtaaagttcagtggaaaatttttctaggaggctctgttcccaagcagcagatgagtcctctgtgctgaagagattgaaggtctgctggatcatctcatggaggacagagatggcttgagccttctggaactggttgccatcaaactcctcctgggggattcggaaatcatgtctgtccttcaggcaggagaaaggagagattcttcccatttgtcccaggagtatcaaggccctcctattacccaggctgtgggtctgaggcagatcacagcctagagaacagatggatttgtagctgagcaccagcacggccataagtaaagaaaaggacagggccattgggatgttgcaaatattgctaggctacttgagatggataaccttgaacttcggcctctaggttttctgaagactttgctctgtgcataggtcttaaatagtgaacatactaatttccattttctaaatgccctagttttactttctatctctgtttttgctttctttatgtactctctccatgtgtttaaaaagtttttcattttttttcatcattgcctatttttcacctgcactcaaagccttttatggtttttttttaattgaaatcttcatgaaattttagtaacacagatttggcatatctatttatgtatattacgtatacctctacttcacagataaaaactacaaagtttgctctttttattcaaagtaaagttaagaattacagaaaagttaaactaaaatctaagtttaaaagctattgacatttattttaatttgataagtatatttgtggaataacttttagtataatttgttcatgcaaattttgtatcaaagtacatatgcaaaataaaaatctatataatacacattaataatatgaatgtagttacctacctaatcattcaaaactcctaaaaatatgaatcaataattttttaaaatttttctcttagtgtatgaagctttgaattttgctttatatgagaaaataatttgtaaattcaccagctgcagtattcatccagatattgccaaaacttttttcttttcagcacttgacacaagtactgatgtattgaataactttagtagaaataaaacatataatgtaagctatttggattgaattctcaaagtctaccaaacatcctgaagaactgaggatcaaacataactaataactataagatagtcaatggcagcccaaagatatgcaggttaaagccacatactgtgataagactttaagatccagcaaaaaatggacaaaaagtcctccaatcacagtcatctatttgctataggtttgtaacattggtcttacaaatattttgtttatcttcatgaactcaataccagtgcttctcatatcatacacaaaaaaacccaatgagaaatatgtatattaagcaataaaattttgttggatagagttgttggaaagtcagaaactattgtaatatgttagattcatttacactacgagaactaatttttgtacccttaaaagaagtatcaatccaataaacatatatgacttagaaaatagtatgatttaaatcatttttggcattttacattgaagttcatattccctaaaggttttcagaagttcctatccaagtcaattcttatcaaataaaaaagaccatctttgttctaaattcataaatttataaatattgaatattattatgcaaagaaataactttcagcatgatcctgaactctggctctaacttttttttttttttttttgtgtaagaagtttttttttgtataagtaggccctatagatactgagtccttaaatggaatgaggtctgctttagcaaatcagctatttagtaagtggagtttttactaatttctcatttattctcatttttaaatggactatacaatggttctatatggcattcacaacagcaaatatatttatatttctcacttaacttttcctagaaggtaaaagtggtctgattttcatcttaatttatgggaacaaaaagaaaacaaatgtatgtctaaatgtgataaacatgtaagaggagaaatacctaatgtaaatgacaagttaatgggtgcagcaaaccaacatggcacatgtatacctatgtaacaaacttgcacgttgagcacatttaacctggaacttaaagtatagtacaaaaaaaaaaaagatgaccagaggggaacttagaaaatatcttgagagaggtgaaaatgaaaacacaacataccaagacgtatgtgatgcagtgaaaacagagctaaaggggaaattgaaagctgtaaaagcttatattaaaaaagaagaaagacctcaaaccaatgaactaactttacaagttaaggaactagaaaagaagaaataaacacacagctaggaagaggaagaaaataagaaagactaaagcagaccccaggtcttcatccttacttctcagtccttgcaagtctgttgatgaagagaaggatttcatgattccactctgacaacctcccaagcacagtcactgtatttcttctctttcaggtagattctctggattcccatggattccctggaagtacctcctcaaggccagtgtagggccccaaacacccccacagattcttcctctcctgttgcctgccctaagcaagactccaggcattcgagctgctgatgaaatccagtgtggagctggtccaggagggtcatgttccaggcagcagaggagcgctctgtggggaagaggctgaagatctgctgaagcatctcatggaggacagacagggcctgggccttctgcaactggctgccatccacatctccagggggaacctgaagtctcttctgtccttgagacacaagaaagtggagattctgcacatttggcccagaagtgccaaggtgttcctgctaagtaggccacggttctgaggcaggtcaaagcccagagatccaacagggccacagtggcaaagcagcagggccaccagtagaacaagcagtaggaccattgggaaacgagggtgctgctggcctagctgagctggggtcgggatgaaccccgcactccaggttctctcaaggcattctttttatatgcatggcttatagctggaaacaaatagttttcaggattggccaagatggccgactggaacctgctagtgtgtgccactctcatggagagaaatggaaggggcaagtaaatacagcaccttcaactgaaacaaccacgtacacacattgagactcaagaaaacaacttgacccatggagaatagagcaaagtaaggcaggacaactgcccccccaggagtgacacagagccaggggagcctctcctgcccagggaagtggtgagtaagtgagcagccctggggacccacgcttctcccacagatctttgcaatcctcaggtcaggagatctcctagtgaacccactctaccagggcgtttagtctgacatccagggctacgtagggttccagcagagcagccgctctcgcatgcatgggtaccctggagccttagatacccaggcctccccacaaaagaagctataactccaaccaagcaggacgctacacgcctgtacatacccgtaggaaaggggtttcatccagggcgctgggcagtgacaagtggcaggcccaccttccattgcctgtctcagggtaagacccactggcttgggaatccagccagacactggtagcagcctcatacctccctgacatggagctcccagcggcagtgggtgggctgccatctttgctatttcacagtcttagctattggagcctttgggttctagtgagttcaaggcagctagggactggagcagccacccagcccagcccagcagctctacggagaagcagtcagattgcttattcatgtcgatcccaaatcctgcttcttttcactgggtggaatctccccactggggtctccagtcacctccaccgctgttttctgcagacagcagtttcgaatatccctgggatggcgcttccaaagggaagggtgggttgccattgttgctgtttagcagccttagccattcttgcaaatgccactcttttgtgctgggggtggtagcagacccccagcacagcacagctgctctaccaaaaggtggccagactgtttcttcacctgattccctgatgctgcttctcctcagtgggtgggatatcgccaccggggtctccagccacctcctgcatgtatgttgcaggaggcaacaggttgtacctctctggaacagagctcccagggggaggggcaggtccccatcttcactgtttcatagccttcactgttgatatcttcaggtactgaaaaatgtgaggtgactatggtctggattggacccccagcatattgcagcagccctatggaaaagtggccagactgtgtgttatgtgggtccctgatcccctctctcctcactgggagggtctgccaggcctgggtctgcagctaccacctggggctattgagccaacagcagctctgcaattccctggaacagagctcccagtgaaaatggtgggttgccatctttgctttctcacagctcttgcccttgctgtctccaggctctgggaagtctgtaaggaatagcggctgctccagatccccaaaacagagcaactgcctcacagaagagtggccacactgttctccacgcagttcctggttgtcacctctcctctgtgggcagagccacctgaccagagactccagcataggcacccttcccctgcctcatctcctcaatcaggcagtccagcatttctccaagaaagaaatcccacagtcagcccacaatccatccatcatgaccgttgcagtgggacagccccagcatccctccggctggggaaggaacaaagggcctattcactacactctcacctccagcacatcatagccactatacaaagaggagtccagcccctcttccctgagaatccccatccctattcttcaggagtcaggacccccagcgcatgactgcaaaacagtcaccctacccatggctgagcatatccactggtagttgactagagtttccctggggagaggctcccagagccagcctacctctgccactgccacagcagcagttttatccctgctgccttgggtctggggaggagacaaagagtccgaagctctttgtttaaaagcttacatcatgccacagtcacctgaacttccagcacactgcagttaccacatggtgaggagaacagtctcctgctggtaagatttccacctcctgtttcccaagaagtgaagtcccatacttacaccagcagtgcagccaccccactcctctggctaaacactcccattaacatggcttcacatttcttggaggtggagaccccaggggtaacagaaagcctgtcttaacattgcctctgcagtggtactaccccagctaccttggaactaatgaaggagcaagaccccaagtgccttatgcatacctccaacaagctgctgtcaacccaagagaggaggccagtctgtctcccattggtcaaccacccacccctcacatcaccaggcagggaacccctgtcttgggcccacagcacagacacccccatccgaagctgaatgcactgagtgattgctcacctgcatctctttggtggagcccccaggagacaagcaaaagaccctcagttacaagtactactaagttctcttcctttaatgcctccaagtcggggagaaaacattaaccctgagatcacctcagagctgttatgtacagcctgggagtgccaagatacaagctacagtcagcactccagtgggagaggagcccacactttcatagcattgaggagcacggctgcaaacgtgaggaaatacgggggagccacatgactgagcaagagcctgacaactgaccactatacctaagactcacctactaggtcatgcccaaaccttcaacactaaaaaatctcactaacacaccctcattaaccaaagacaagtcaacttcaaataaagaccctgcacaaagctgcagccctgtgaacacatccagaaccgaagtctatttattgattgaactcaagctacactcccatatgtagagatgagaaagaaccaatggaagaactacagtatctcaaatggaccgagtatctgatgtcctccaaataatctcactagttctccaacaagggttcttaaccataatgagttagctaaaatgacagaaatataattcagaataggatagaaaggaatttcattgagattcaggaaaatgataaaacctaaaccaaggaaactaagaatcacaatcaaatgagagcggagttgacagacaaaatagccagtatgaaaaagaacctaacggacctagtagatgtacacactacaagaatttcacaatgcaatcacaagtattaacagcagaatagaccaagctgaggacagaatctcaggacttgaagactggctctctgaaataagacaaccagacaaaaataaagaaaaaagaatgaagagcaatgaacaaaacctccaagaaataggggattgtataaagaggccaaatctaagaatcacttgcatcctttaaaaagacagggagaaagcaaacaacttggaaaatatatttcaggatatcatctatgaaaactaccacaaccttgatagagagaccaaaagtcaaattcccttgaagttctacacccagattggcaggctgttctaattcctagtgtagcacaatccatagaggaagggataagttaggaggccccggggaggctgggcaggctggaggaaagggacacatcctgaccctttgtctttccccatagctgtccattgccccaagatgacatgtcatgcctgaagctgggagtattttctctctccacgatacagaagttgaggaaatgggctaattccactaccagggtccattctttcttgggaagagcctctttttagctgtgaaattaaatctcctgccaggaggcctacttctgcattaacagcctgctctccacagacttggctgctgtcttggtgcactttgggggctctctttccctgtaaatgttgtaagagtctcaaagtaaaatggaacctgccttttatttccttttttgctaagctactgttatgtcattgtaacagcgacattctgtcttttacagaaatagtcatcataagaaaggaaaaagagtattttataaaagagcttctgaaaaacctagaactttcactgaacttctgctttaatttgtgattttgtgctcttaaggggaaagtgatgggtaaaacccacaagagaactgaaaacagctgtatgaagaggcagtgcaggctaatgatgagtgaagaagagagcacagtgcgcatttctagaggaagaggaaggaaactaatgtgatatgggagtgaaaaacgggacacagaaaagcagggaggaaaagggaaagtgtgtcagctctcagaaccagcaaagatatatattttacttaagtttaggagagtaacttcatatgggagtgtactctgggattctgagagccaggaaacaaatgttccaggtgccagaatcagttaaccatcgacacgtgtattctgcccttcactctagatgctgctcctctgacaggtatttatacaagccaccattcctgactgaatataaatgggactttgaaatgaggtgagaatttttcagcctctctagaattcatgacagaattctgttgttttaggctgcctaaaaacagtatatacaagcagaatggaatttcaatgtaaaataagttattatttttaccggatgtgtaaattttgtgttaggatttccttaataattattaatctccttttttcctcatttatacgcaaccatctcctgctctctgaatttccttggttcatgttgtattttcagctgattttgaccaactttctttttaaattttgctgtaagttccgggataggtgtgcagaacgtgcagatttgttacataggtatacatgtgccatggtggtttgcctcacctatcaactcgtcacctaggttttaatcacaatttgttttaatccagtgtattattgatgggcatttgggttggtttcgtgtctttgccattataaacagtgctgcaatacacatacacgttcatgtattttataacagaacgatttatattcctttgggtatatagtcagtaatgggattgctgggtcaaatggtatttctggttctagatccttgatgaatcgccacactgtcttccacaatggttgaagtaatttacattccctccaacagtgtaaaagatttcctatttttctacagcttcaccagcatctgttgattttgactcttcaataattgccattctgagtggcatgagatggtatttcattgtggttttgattcgcatttctctaatgatcagcgatgttgagtttttaaatgattattggcctcataaatgtctacttttaagaagagtctgttcatatccttcacccactttttgatggggctctttgtttttgtaaatttaagctcttttttgtacattctggatattagacctgtgtcagttgggtaggctgcaaagattttctcccattctgtgggttgcctgttcactctgatgatggatagtttcttttgcgtgcatacgttctctaattagatgccatttgtcagttttagcttttgttgcagttgcttttgtcgatttcttcataaaatctttgcccatcctgtgtcctacattttttctagggtttttatggttttgggttttacatttaagtctttaatccatcttgagttaatttttgtataaggtgtaaggaagtggtccagtttcaattttctgcctatggctatccagtttttccagcaccatttatcatcattccttctaaatacattttatcatcattccctctcgtccttctaatgataaggtattccacctctgttttctttgtgtgtcttctgttcccccactttaatagtggaagttcctcagaatccagtttaagtctttttttccctctccgcttgctccccacatgacagccttcattttaggcctttccattgccagttatgaacttccagatatcgtattccttggaaactgcaaactcatatatctgacttgcaatgtacattttcaattacatgttgaaagtcagtttatagagagtatctctacttttacttgcagacatttcttaatctatgttctgctaagaggaattcattgtttttttttacttcctcacattacagcagttagtataactgatattaattcagcattattattgtttttagaaacatttcctgacaaaaatcaaagatacaagacaacaagaactgtattttttatgttcaagtttatatcctgaaggcaacatataacgtggtatagaaaaatatatttttctataacttgaataaaattatgataggtaacttacttaaatcatctatttttaagtcaggttatacagtcaggcttggtatttaatcttaaaaaataaacaaacacaagaaattttgtatagtaaaaatttaatgaaaaggaagttaatatattaactaaatatgaagaacatatattgttacattaagcaaaatgtaaaggtacacatgatattacataaaacatgatttaaaccttaaaaatagttaaataaataaatatttaaataaatagatgaatagagacatcagcatggtcatctgtaaaggactagtgcctgcacaggtaaacacgatgcttctttacactcctgaaaacatttgaaaattttgattcaacttgtggtggttatagaagtgagtctttgaaatggaagaactcatgaaagtgtgagatgatgtattaatcaatgaggatcatttccatgttgaatgagttttcaatccttccttcttaatcctttttgcaagtttgttgaaaaagagaaggatctcatgatttctgctctgacaacctcccaggcacaagggctgtatttcttccccatcagataaagagtgattctttgaaagtatttcctcacagccaggatggagtcctcattcatcagggcaatctcttccaccccaacctcctgtgtcacacaggcttctaggtcattcagttgctggaaaagttcaatgtagaatttgtctaggagggtctcatcccaagcagcagatgaatcctttgtgctgaagagattgaaggtctgctggatcatctcatggaaggcagagatggcttgagccttctggaactggttgccatcaaacacctcctgggggaatccgaaatcatatctgtccttcaggcaggagaaatgagagattcttcccatttgtgccaggagtatcaaggccctcctattacccaggctgtgagtctgaggcagatcacagcccagagaacagatggatttgtagctgagcaccagcacggccatcagtaaagaaaaggacagggccattgggatgttgcaaatattgctaggctactggagatgggtaaacttgaaccttggcctctaggttttctgaagactttgctctgtgcatagttcttaaatagtgaacatactaatttccattttctaaatgccctggttttactttctatctctgtttttgctttctttatgcactctctacatgtgtttacatatgtttttcattttgttcatcattgcctatttttcccctgcactcaaagacttttatggtattttttactaattggaatcttcatgaaattttaataacacagatttggcatatctatttatgtatactacgtatacctctacttcacagataaaaactataaagtttgctctttttattcaatgtaaagttaagaatgacagaaaagttaaactaaaatctaagtttaaaagctgttgacatataacttaatttgataagtatatttctggaataacttttagtgtaattcattaatgtaaattatattttatcaaattacatatgcaatataaaagctatataaatacacgttaatatgaatgtaattacatactgaatcattgaaaactactaaatatatgaatcaataattttttaaaatttttctcatagtgtatgaagctttgaattttgcttaatatgagaaaataatttgtaaactttactagctgcagtattcatccagatattgccaacacttttttcttttcagcacttgacataaatattgatgtgttgaataactgtactagaaataaatcatatgatacaagctatttgcattgaattctcaaagtctacaaaacatcctgaagaactgaggatcaaacataagcaataaccataagatagtcaatggcagcccaaaggtgtgcaggttaaagccacatattatgataagattttaagatcaagcaaaaatggacagaatgtcctcctatcacagtcttctatttgccataggtttgtaacactgatcttgcaaatattttgtgtatcttcaggaactcaatatcagtgcttctcatgtgatacagcagaaaatccaatgagagagatgtatattaagcaatgaaattttgttggacagagttgttagagaatcaccaactattgtaatgtgttaggttagtttatacttcgagaacccttaggagaagtatcacatagacatatgtgacttagaatatattatcatgtaaagaattaattttcagagtggtcctgaactctgactctaccttttcttttgcctaagaagttagtttgccttggccctatagatactgagtctttaaatggaatgaggtctgctttagcaaatcagctatttagtaagtggagtttttactagtttctcattttttcttctactggaaagtgttcaagaatgaagctattttgcttcctcatggccatatttgctgggattgtaatagacaatgacaaaagtttccattcagcttttactgagagtcaataatgcccatttagtttactgcttaaaccactgggattctagtttttttaaggttcatgtagatctggggatacaagttgcaagagcagcataatatcatcctttgctagcactatgttaactatttatggcttcatctctaatctgtcctctattttgtgataatagaaaataagtagcctggtgtcaaatacagagtcacatatctaatttcaaactctccaattcacacagtttataggaatcagacaatttactattcccaaaagtagggaataatagcctctatcccccaaataatcctacagctttccttccctggatcaaatccccagaatgtgtatgtgaacggtagatacttgtgacatcatttttccatcatttataaatttcagtttcaaatcacgtgataatctttagatgacactagtagaaaattagcctgtttatataaaggtagagattatgaaatggaccaattttagaaaataaccaaacacattttattattcattattttaaatgattcacttaaattctttatatcattgaacaattaaaatattctacattttgaaatgtgcacaggggtttccataatagaggaggtttcatttcagaaatgtatattttgtacattaatttagtagttgatccagtcaacacatttttattgaattttgggctaatcctttgtatcagacccggacaatacagggcaattttgcccaagttattatgcttagtctttgaaacactgggggagagagtattttttctttgttcacttgcgattgtatggggaatttttgcgtattcattttttatgtagtattttactgtgaaaatttgtttttctatactttgatttctttcattttcatattcaggttagtgtcaatgaaacaatgtacccagtagtcattcaggagcaggttgttcagtttccatgtagttgagcggttttgagtgagtttcttaatcctgagttctagtttgattgcactgtgctctgagagacagtttgttataatttctggtcttttacatttactgaggagagctttacttccaactatgtggtcaattttggaataggtgtggtgtggtgctgaaaaaaatgtatattctgttgatttggggaggagagttctgtagatgtctattaggtcgacttggtgcagagttgagttcaattcctgggtatccttgttgactttctgtctggttgatctgtctaatgttgacagtgtggtgttaaagtctcccattattattgtgtgggagtctaagtctctttgtaggtcactaagcactactcggtacataacgaaatgaaggcagaaataaagatgttctttgaaaccaacgagaacaaagacacaacataccaaaatctctgggacacattcaaagcagtgtgtagagggaaatttatagcactaaatgcccacaagagaaagcaggaaagatccaaaattgacattctaacatcacaattaaaagaactagaaaagcgagagcaaacgcattcaaaagctagcagaaggcaagaaataactaaaatcagagcagaactgaaggaaatagagaccaaaaaaacccttcaaaaaattaaccaatccaggagctggtttttcgaaaggatcaacaaaattgatagaccgctagcaagactaataaagagaaaaagagagaagaatcaaatagacacaataaaaaatgataaaggggatatcaccactgatcccacagaaatataaactaccatcagagaatactacaaacacctctatgcaaataaactagaaaatctagaagaaatggataaattcctcaacacatacactcccaagactgaaccagcaagaagttgaatctctgaatagaccaataacaggatctgaaattgtggcagtaatcaatagcttaccaaccaaaaagagtccaggaccagatggattcacagccgaattctaccagaggtacaaggaagaactggtaccattccttctgaaactattccaatcaatagaaaaagaaggaatcccccctaactcattttatgagaccagcatcatcctgataccaaagcctggcagagacacaaccaaaaaagacaattttagaccaatatccttaatgaacattgatgcaaaaatcctcaataaaatactggcaaactgaatccagcagcacatatagaagcttatccaccatgatcaagtgggcttcatacctgggatgcaaggctggttcaatatacgcaaatcaataaatgtaatccagcatataaacagaaccaaagacaaaaaccacatgattatctcaataattgcagaaaaggcctttgacaaaattcaacaacccttcatgctaaaaactctcaataaattaggtattgatgggacgtatctcaaaataataagagctatctatgacaaacccacagccaatgtcatactgaatgggcaaaaactggaagcattctctttgaaaactggcacaagacagggataccctctctcaccactcctattcaacatagtgttggaagatctggccagtgcaattaggcagaaggaaataaagtgtattcaactagaaaaagaggaaatcaaattgtccctgtttgcagatgacatgattgtatatctagaaaactccattttctcagccccaaatctccttaagctgataagcaacttcagcaaagtctcaggatacaaaatcaatgtacaaaaatcacaagcactcttatacaccaataacagacaaacagagagccaaatcatgagtgaactgccattcacaattgcttcaaagagaataaaatacttaggaatccaactgacaagggatatgaaggaactcttcaaggagaactacaaaccactgctcaatgaaataaaagaggatacaaacaaatggaagaacattccatgctcatgggtaggaagaatcaatactgtgaaaatggccatacggcccaaggtaatttatagattcagtgccatccccatcaagctaccaatgactttcttcacagaattggaaaaaactagtttaaagttcatatggaaccaaaaaagagcccgcaccaccaagtcaatcctaagccaaaagaacaaagctggaggcatcacgctacctgacttcaaactatactacaagcctacagtaaccaaaacagcatggtactggtaccaaaacagagatatagatcaatggaacagaacagagccctcagaaataacgctgcatatctacatgtatctgatctttgacaaacctgagaaaaacaagcaatggggaaaggattccctatttcataaatggtgctgggaaaactggctagccatatgtagaaagctgaaactggatcccttccttacaccttatacaaaaattaattcaagatggattaaagacttaaacgttagacctaaaaccataagaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcacaacctacttatctgacaaagggctaatatccagaatctacaatgaactcaaacaaatttacaagaaaaaaaccaacaaccccatcaaaaagtgggcaaaggatatgaacagacacttctcaaaagaagacatttatgcagccaaaagacacatgaaaaaatgctcatcatcactggccatcagagaaatgcaaatcaaaaccaccatgagataccatctcacaccagttagaatagcaatcattaaaaagtcaggaaacaacaggtgctggagaggatgtggagaaataggaacacttttacactgttggtgggagtgtaaactagttcaaccattgtggaagtcagtgtggcgattccttagggatctagaactagaaataccatttgacccagccatcccattacagggtatatacccaaaggactataaatcctgctgctataaagacacatgcacacgtatgtttattgaggcactattcataatagcaaaggcttggaaccaacacaaatgtccaacaatgatagactggattaagaagatgtggcacatatacaccatggaatactatgcagccataaaaaaggatgagttcatgtcctttgtagggacatggatgaaattggaaatcatcattctcagtaaactatggcagggacaaaaaaccaaacaccgcatgttctcactcatagatgggaattgaacaatgagaacacatggacacaggaaggggaacatcacactctggggactgttgtggggtggggggaggggggagggatagcattaggagatatacctaatgctaaatgatgagttaatgggagcagcacaccagcatggtacatgtatacttatgtaactaacctggacattgtgcacatgtaccctaaaacttaaagtataataataataaaaaataaataaataaataaataaattgaaaaaaaagaaagaatataaatataatgtttaagtgggctatacaatggttttatgtggcattcacaacaacaaatgtatttatatttctcacttcatttttcctggaaggcaaaagtggtctgatttttcatcttaatttatgggaacaaaaagaaaacaaatgtatgtctaaatgtgataaacatgtaagaggagaaatacctaatgtaaatgacaagttaatgggtgcagcaaaccaacatggcacatatatacctatgtaacaaacttgtgcgacgtgcacatgtaccctagaatttgaagtataataataaaaataaaaaagaatgaccagaagggaacttagaaaatatcttgagacagatgaaaatgaaaacacaacataccaaaacatatgtgatgcagtgaaaacagagctaaaaaggcaattgaaatttgtaaaagcttatatcaaaaaagacgaaagactaaaatcaatgaactaactttacaagttaagtaactagaaaaagaagaaataaacacatagctaggaagaggaagaaaataagaaagactaaagcagaaattaataaaatacagaatagaaaagattaaaaaatcaatggaactaagcattagtcttttgaaaggatcaacaaaattgagaaacccttaactatattaagaaataagtagagaaaaatcaaataaatatcagaaataacagaggacacataacaactgatggcatagaagtaaaaaggattggccgggcgtggtggctcacgcctgtaatcccagcactttgggaggctgaggcaggcagatcacgaagtatggagatagagaccatcctggctaacacagtgaaaccccatctctactaaaaatacaaaaagatcagccgggcgtggtggcgggcacctgtagtcccagctactcaggaggctgaggcaggagaatggtgtgaaccccggaggcggagcttgcagtgagccgagatcgcgccactgcgttccagcctgggtgacagagtgagactctgtctcaaaacaacacatggacacaggaaggggaacatcacactctggggactgttgtggggtggggggaggggggagggatagcattgggagatatacgtaatgctagatgatgagttagtgggtgcagcgcaccagcatggcacatgtatacataggtaactaacctgcacattgtgcacatgtaccttaaaacttaaagtataataataataaataaataaaaatatatatatgcaagcagaatggaatttcaatgtaaaataagttattgttatttatacatgatgtgtaaattttgtattgggatttcctttaattattaatctccttttttcctcaattatacacaaccatctcctgctctctgaatttccttggttcatgttgtattttcagctgattttgaccaactttctttctttctttctttctttctttctttctttctttctttctttctttctttctttccttccttctttctttctttttgattttgctttaagttctggaatacacgtgcagaacatgcagatttgttacataggtatacgtgtgacatggtggtttgctgcacctatcaactcgtcacctaggttttaagcacaatttttttaatccagtctctcattgatgggcatttgggttggtttcctgtctttgctattgtaaataatgctgcaataaacatacacatgcatgtatttttataagagaatgatttatatttctttgggtatatactgaggaatgggattgctgggtcaaatggtatttctggttctagatccttgatgaatcgccacattgtctttcacaatggttgaactaatttgtgttcccaccaaaagtgtaaaaactttcctatttctccacagcttcaccagcatctgatgtttcctgactttttaataatcaccattctgagtggcatgagacggcatctcatagtggttttgatttgcatttctctaataatcagtgatgttgagcttttttcatgtttattggccgcataaatgtctgcttttgagaagtgtctgttcatgtcctttgcccactttttgatggggcttgttttttctttgtaaatttgtttaagttctttttacattctggatattagacctctgtcaactgggtagactgtaaaaattttctcccattctgtaagttgcctgttcaccatgatgattgatagtttcttttgctgtgcagaagctctttaattgatgccatttgtcaattttagctttggttgcagttgcttttggcaatttcatcataaaatctttgcccatgccgatgtcctcaatgctattgcctacattttcttctagggtttttctgcttttgaactttacatttaagtgtttaatccatcttgagttaatttttgtataaggtgtaaggaaagggtccagtttcagttttctgcatatggccatccagttttcccagcaccacttattaaatagggaatcctttccccattcctaaagtattgagaaagagattctcttttccagtttctaattttattttatgaaagaaatgtgtcagtttttactgacatttaacagagtattaatcacaataatgatcaattactattgtaaataattttatattttatgctttaaatatataaaatattaaatgtatttatatgatttaccaatgcatcacatttatgaaatttattcattgacatgtattttcaaaaaggaaacactatgcagataaaagataatccacagttttgggggttccagcttatgacttccctccattgcaaaggcagatctctcacaattttctgtatgtgttatcttgatttttcttttctgattcactcttctacctaccccagtatggcttctgctgattaattctatcaatccagctctcagtaagctctgcattgccatctattttcttgctgtagtgctcagttttaattcacattttccataagtttattgatttcttttctaagcacatttattttctaaatacacttttttaattttttaaatttaatttaattttattattattatactataagttttagggtacatgtgcacaatgtgaaggttagttacatatgtatacatgtgccatgctggtgtgctgcacccattaactcgtcatttagcattaggtatatcttttatcatcattccctctcgtccttctaatgttaaggttttccacctctgttttctttgtgactcttctgtacccccactttaatggtggaaggttctcagaatccagtttaagtctttttttccctctccacttgctccccacatgacagccttcattttcgggctttccattgccagttatgaacttccagatttcgtatgccttggaaactgcaaattcacatatctgacttgcaatgtacatcttcaattacatgttgaagtcagtttacagagaatatctctgcttttatttccagatatgtctcaatctacattctgctaagaggaattcattgtattttacttcctcacattatagcagttagcatcactgatattaattcagcattattattgtttttagatttctttcctgacaaaaatcaaagatacaagagaacagggactgtatattttatgttcacgtttatatcttgaaggcaacatataaccaggtacagaaaaatgtttttttaataacttgaataaaattatgatagataacttaattaaatcatatatttttaagtcaggttgtaaagtcagcctcgacattttatcttaaagaataaacaaacacaagaaattttgtatagtaaaaatttaatgaaaaaggaaattaatatattggctaaatatgaagaacatatattgttacattcaccacaatgtaaaggtacacatgatattacataaaaaaataatttaaatcttaaaaataattaaataaatatttaaataaatagatgaacagagacatcagcatggtcatctgtaaagtactagtgcctgcacaggtatacacgacgcttctttacactgctgaaaacatttgaaaattttgattcaactcgtggtggttatagaagtgagtctttgaaatggaggaactcatgaaagtgtgagataatgtattagtcaatcaggatcattgccatgttgaaccagttttcaatccttcctccttaatattttttgcaagtttgttgaaaaagagagagatctcatgatttctgctctgacaacctcccaggcacaagggctgtatttcttctctgttagataaagagtgattctttggaagtatttcctcacagccaggatggagtcctcattcatcaggggagtctcttccatcccaacctcctgtatcacacatgcttccaggttattcagttgctggtaaagttcagtggaaaatttttctaggaggctctgttcccaagcagcagatgagtcctctgtgctgaagagattgaaggtctgctggatcatctcatggaggacagagatggcttgagtcttctggaactggttgccatcaaactcctcctggggaagtccaaagtcatgtctgtccttcaggcaggagaaaggagagattcttcccatttgtgccaggagtatcaaggccctcctattacccaggctgtgggtctgaggcagatcacagcctagagaacagatggatttgtagctgagcaccagcacggccatcagtaaagaaaaggacagggccattgggatgttgcaaatgttgctaggctacttgagatgggtaaccttgaactttggcctctaggttttctgaagactttgctctgtgcataggccttaaatagtgaacatactaatttccattttctaaatgccctagttttactttctatgtctgtttttgctttctttttgcactctctacatgtgtttaagaatgtttttcattgtttttcatcattgcctatttttcccctgcactcaaagtcttttatggtatttttttgtaatcgaaatcttcatgaagttttaataacacagatttggcatatgtatttatgtatactatgtatacctctacttcacagataaaaactataaagtttgctttttttatttaacgtaaagaatgacagaaaagttaaactaaaatctaagtttaaaagctattgacatttaacttaacttgataagtatatttgtgaaataacttttagtgtaatttgttcatgtaaattttgtatcaaagtacctatgcaaaataaaaatctatataaatacacattaataatatgaatataattacatacctaatcattcaaaactcctaaaaataagaatcaataattttttaaaatttttctcttagtgtatgaagctttgaattttgctttatatgagaaaataatttgtaaacttcactagctgcagtattcatccacatattgccaacacttgtttcttttcagcacttgacataaatgtatatgtgttgaataactttagtagaaataaatcatataacataagctatttgcattgaattctcaaagtctaccaaacatcctgaagaactgaggatcaaacataagtaataaccataagatagtcaatggcagcccaaatatatgcaggttaaagccacatactgtgataagactttaagatccagcaaaaaatggacaaaaagtccttcaatcacagtcatctatttgccataggtttgtaacactgatcttacaaatattttgtttaccttcatgaactcaataccagtgcttctcatatcgtacacaagaaaatccaatgagaaagatgtatattaagcaatgaaattttgttggatagagttgttggagagtcacaaactattgtaatatgtcagatttgtttacataaactacaagaactaatttttgtactcttcgaagaagtatcattccaataaacatatgtgacttaggaaatattataagttaaatcatttttggcatttttcattgaagttcatattccctaaagattttcagaagttcctatccaagtcaattcttatcaaataaaaaagaccatctttgttctaaattcataaatttataaatattgaatattattatgcaaagaattaactttcagagtggtcctgaactctggctctacttttttttttttttttgcataagtaggccctatagatactgaacccttaaatggaatgaagtctgctttagcaaatcagctatttagtaagtggagtttttactagtttctcattttttcttctactggaaagggttcaagaatgaagccattttgcttcctcatgcacatatttgctgggattataatagataatgacaaaaatttccattcagcttttactgagagtcaataatgcccatttagtttactgctaaaaccactgggattccagtttttttaaagtgcatgtagatctggggattcaagttgcaagagcagcataatatcatcctttgcctagcactatattaactatttatgacttcatctctaatctgtcctctactttgtgataatagaaaataagtagcctggtgtcaaatacagagtcacatatctaaattcaaactctccaattcacacagtttataggaatcagacaatttactattcccaaaagtatggaataatagcctctctcccccaaataatcctacagctttccttccctggatcaaatcccaagaatgtgtatgtgaattgtaaagacttgtgacatcatttttccatcatttataaatttcagattcaaatctcgtgataatctttagatgacactggtagaaaatgagctggtttatatgaggtagaaattatgaaatggatcaattttagaaaataaccaaacacattttattattcattattttaaatgattcacttaaattctttatatcattgaacaattaaaatattctacattacgaaatgtgcacaggggtttccatactagaggagccttcatttcaggaatgtatattttgtacattgatttagtagttgatccagtcaacacatttttattgaattttgggctcatccttttattagaccctgagaatacagggcaattttgcccgagttattattcttagtctttgaaacactgggggagagagtattttttctttgttcacttgagattgtattgggaatttttgcatattcattttttatgttgtattctaccgtgaaaattggtttttctatactttgatttctttcattttcacattcacgttagtgtcaatgaaagaatacaaatataatttttaaatggactatacaatgattctatgtggcgttctatgtggcattcacaacagcaaatatatttatatttctcacttcacttttcctacaaggtaaaagtggtctgatttttcatcttaatttatgggcacaaaaagaaaacaaatgtaggtctaaaagtgataaacatgtaagaggagaaataccttatgtaaatgacaagttaatgggtacagcaaaccaacatggcacatacttgcacgttgagcacatttaccctggaacttaaagtatagtaaaaaaaaaatgcccagaggggaacttagaaaatatcttgagagagatgaaaatgaaaacacaacataccaaaacatatgtgatgcaatgaaaacagaggtagaggggaaaatgaaagctgtaaaagcttatattaaaaaagaagaaagacctcaaacgaatgaactaactttacaagttaaggaactagaaaaagaaggaataaacacatagtaaggaagaggaagaaaataagaaagactaaagcagaccccaggtcttcatccttacttctcagtccttgcaagtttgttgatgaagagaaggatttcatgattccactctgagaacctcccaagcacagtcactgtatttcttctctttcaggtagattctctggattcccatggattccctggaagtacctcctcaaggccagtgtagggccacaatcacccctacagattcttcctctcctattgcctgccctaagcaagactccaggcatcctagctacagatgaaatccagtgtggagctggtccaggagggtcatgttccaggcagcagaggagcactctgtggggtagacgctgaagatctgctgaagcatctcatggaggacagacagggcctgggccttctgcaactggctgccatccacatctccagggggaacctgaagtctcttctgtccttgagacacaagaaagtggagattctctgcatttggcccagaagagccaaggtgttcctgctaagtaggccatggttctgaggcaggtcaaagcccagagatccaacagggccacagtggcaaagcagcagggccaccagtagaagcagtaggaccattgggaaacgagggtgctgctggcctagctgagctggggtctggatgaaccctggactccaggttctctcaaggcattctttttatgcatggcttatagttggaaacaaatagttttcagggttggccaagacggccacctagaagctgctagtgtgtgccactctcgtggagagaaatggaaggggcaagtaaatacagcaccttcaactgaaacatccaggtacacacattgggactcaacagcttgacccatggagaacagagcaaagcaaggcaggacgactgcccaccaaggagtgtcacagagccaggggagcctctccttcccagggaagtggtaagtcagcagccctggggacccatgcttctctcacggatctttgcaatcctcagatcaggagatctcctagtgaacccactctaccagagccttcagtctgacatgcagggctacgtagggtttcagcagagcagctgctcaggcatgcatgggtaccctggagccttagatacccaggcttccccacaaaagaagctataactccagccaagcaggacgctagacccctatacatacccctaggaaaggggtttcattcagggtgctgggcagtgacaagtggcaggcccaccttccatggcctgtctcagggtaagacccactggcttgggaatccagccagacactggtagcagcgtcacacctccctgacatggagctcccaccggcagggtgtgggctgctatctttgctgtttcacagccttagctattggagcctttgtgttctagggagtccaaggcagctagggactggagcagccacccagcacagcccagcagctctacagagaagcagtcagattgcttattcacatcgatcccaaatcctgtttcttttctgtaggtggaatctccccactggggtctccagtcacctccaccactgttttctagtggaccgcagtttcgaatatccctgggatggcgctcccaaagggaagggtaggtagcctttgttgccgtttagcagccttagccattcttgaaaatgccattcttcgtgctggcggtggtagcagacccccagcacagcacagctgctctaccaaaaagtggccagactgttttttcacctgagtccctgatactgtttctcctcagtgggtgagatatccccaccggggtctccagccacctcctgcatgtatgttgcaggaggcaacaggttgtacctctctggaacagagctcccagggggaggggcaggccctcatcttcactgtttcatagccttcactgttgatatcttcaggtactgaaaaatgtgaagtgactatggtctggattggacccccagcatattgcagcagccctatggaaaagtggccagattgtgtgttatgtcggtccgtgatcccctctctcttcactgggtgggtctgccaggcttgggtctgcagctaccagttggggctattgagccaatgacagctctgcatctccctggaacagagctcccagtgagaagggtgggttgccatctttgctttctcacagctcttgcccttgctgtctccaggctctggagagtctgtagggaacagtggctggtccagatccccaaaacagagcaactgcctcacagaagagtgaccatactgttctccatacagttcctggttgtcacctctcctctgtgggcagatccacctgaccagactccagcacaggcacccttcccctgcctcatctcctcaatcaggcagtccagcatttctcaaaggaagaaatcctacagtcaacccacaacccatccaccactactgttgcagtgggacagccccagcagccctctggctggggaaggaacaaagggcctagtcactacactctcacctccagcacaccatagccaccatacaaagaggagtccagcctttcttccctgagaatctgcatccctattcttcaggaggcagggcccccagcccatgactgcaaaacagtcaacctacccatagctgagcatatccactggtagttgcctggagtttccctggggagaggctcccacagccatcctacctctgccactgccacagcagcagttttatccctgctgccttgggtctggggaagaaacaaagagtctgaagctctttgtttacgagcttgcagcaagccactgtcacatgaacttacagcacactgcagttaccatatggtgagaacagtctctcctcctggtaagattgccaccttctattacccaaaaagtgaagccccaagcttacaccagcagtgcagccaccccactcctctggctaaacactgccattaacatggcttcacatttcttggaggtggagaccccaggggcaacagaaagcctgtctaccactgcctctgcagtggtactaccccagctaccttggaactgatgaaggagcagagacctcaagtaccttatccatacctccaacaagctgccgtcaacccaagagaggaggccagtctgtctgccattggtcaatcacccacccctcacatcaccaggcagggaacccctggcttgggcccacaggacacactcccatcccacgctgattgcactgagtgactgctgacctgcttctctgtggtggagccccccggagacaagcaaaagaccctcagttacaacaactactaaggtcccttccttcgatggctccaagttggggagaaaacattaaccctgagatcaccccagagctgttgtgggcagcctgggagtgccaagatacaaggtacagtcagcactcaagtgggagaggagcccaaactttcaaagcattgagatggagcacgtgtacaaccgtgaggaaatgtaggtgagccccatgactgagcaagagcctgacaactgaccactgcacctaagagtcacctactaggtcatgcccaaagcttcaacaccaacaaatctcactaacacaccctcattcaaccaaagacatgtcagctacaaataaagaccctgcacaaagctacagccctgtgaacacagccagaaaataagtctctttattgattgaactcaagctacactcccatatgcagagatgagaaagaaccaatgcaagaactacagtaactcaaatggacagagcatcttatgtcctccaaataatcacactagttctccaacaagggttcttaaccaaaatgagttagctaaaatgacagaaatataattcagaatagggatagaaaggaattccattgagattcaggaaaacagtaaaacctaaaccaaggaaactaagaatcacaatcaaaagagagaagagttgatagccaaatagccagtatgaaaaagaacctaacggacctagtagatgtacacactacaagaatttcacaatgcaatcacaagtattaacagcagaatagaccaagctgaggacagaatctcaggacttgaagactggctctctgaaataagacaatcagacaaaaataaagaaaaaagaatgaagagcaatgaacaaaacctccaagaaatagggggtggtataaagaggccaaatctaggaatcacttccatcctttaaagagacagggagaaaacaaacaacttggaaaatgtatttcaggatatagtctatgaaagcttccacaatcttgatagagagatcacaaatcaaattcccttgaagttctacacccagattgaccggctcttctcattcctagtctagcacaatccatagaggaagggataagttaggaggtcccggggaggctgggcaggctggaggaaagggacatatccagaccctttctctttccccatagctgtccattgccccaagaggacatgtcatgcctgaagctgggagtattttctctctccacgatacagaagttaaggaaatgggctaattccagtaccgtgatagttctttcttgggaagagcctctttttagctatgaagataaatatcctgccaggaggcctacttctgcattcacagcctgctgtcctcagacttggctgctgtgttggtgcactttgaccagttggtggctctctttccctgtaaatcttgtaatagtctcaaagtagaatggaacctgcgttttatttccttttttgctaagctactgttatgtcattgcaacagcgacattccgtgttttacagaaatattcatcataagaaaggaaaaagagtattttataaaaagagcttctgaaaaacctagaactttcactgaccttctgctttaatttgtgattttgtgctcttaagggaaaagtgatgggtaaaacccacaagagaactgaaaacagctgtatgaagaggcagtgcaggctaatgatgagtgaagaagagagcacagtgcgcatttctagaggaagaggaaggaaactaatgtgatatgggagtgaaaaaatgggatacagaaaagcatggaggaaagggaaaagtgtgtcagctctcagaaccagcaaagatgtatattttacttaagtttaggagagtaacttcatatgggagtgtactctgggattctgagagccaggaaacaaatgttccaggtgccagaatcagttaaccatcaacacgtgtattctgcacttcaatctagatgctgctcctctgtcaggtatttatagaagccaccatttcctgactaagtgtaagtaggactttgaaatgaggtgagacaatttttcagcctctttagaattcatgatagaattctgtttttttaggctgccaaaaaaatatatatgcaaccagaatggaatttcaatgtaaaataagttattgttatttatacctgatgtgtaaattttgaattgggatttgcttaataattattaatctcgttttttcctcatttatacacaaccatctcctgctctctgaatttccttggttcatgttgtattttcagctgattttgaccaacttgctctctctctttctttcttttttttttttttgattttgctttaagttctggaatacatgtgcagaacctgtagatttgttacataggtatacatgtgccatggtggtttgctgcacctatcaacttgtcatctaggttttaagcacaatttttaaaaatcccatctatcattgatgggcatttgggttggttttgtgtctttgctattgtaaatagggctgcagtaaacatacacgtgcatgtattttcataatagaatgacatatatttctttgggtattactcaggaatgggattgctgggtcaaatgctatttctggttctagatccttgatgaattaccacagtcttccacaatggttgaagtaatttacattcccaccaacagtgtaaaagctttcctgtttttccacagcttcaccagcatctgttgtttcctgactttttaataatcaccattctgaggggcatgagatggtatctcattggtgttttgattttcctttctctaatgatcagtgatgttgagcttttttcatctttatgggccacataaatgtctccttttgagaaatgtctgttcatgttttgccactttttgatgtttttttttctaaatttgtttaagttctttttacattctggatattagacctctgtcaattggatagactgcaaaaattttctcccgttctgtaggttgcctgttcgctgtgatgactgataatttcgtttgctgtgcagaagctctttaattagatgccatttgtcaattttagctttagatgcagttgcttttggcaatttcatcataaaatctttgcccatgcctatgtcctgaatgctattgcctatgttttattctagggtttttatggttttgggttttacatttaagtcttatatccatcttgagttaatttttgtataagatgtaaggaagggtccagtttcagttttctgcatatggctatccagttttcccagcaccatttattaaatagggaatcctttccccattcctaaagtattgagaaagagattctcttttccagtttccaattttattttatgaaagaaatgtgtcagtttttactgacatttaacagagtattaatcaaaataatgatcaattactattgtaaataattttacattttatgctttaaatatataaaatattaaatgtattaatatgatttatcagtgcatcacatttatgaaatttattcattgacatgtattttcaaaaaggaaacactatgcagataaaagataatccacatttttggcgggtccaacttattacttccctccattgcaaaggcagatctttcacaattttctgtatgtgttatcctgatttttcttttctcattgattcttctacctaccccagtatggcttctgctgattaattctatcaatccagctctcagtaatctctgcattgccatctattttcttcctgtagtgctcagttttaattcacattttctataagtctattgattctttttataagcatgtttgttttctaaatacacttttatcatcattccctcttctccttctaatattgaggtattccacctctgttttctttgtgtctcttctgttcccacactttaatggtggaaggtcctcagaatccagtttaagtcttttttccctctccacttcctccccacatgacagccttcatttttggcctttccattgccagttatgaacttccagatatcgtattccttggaaactgcaaactcatatatctgactggcaatgtacattttcaattacatgtttgaaagtcagtttatctctacttttttttccagacatgtctcaatctaccttgtgctaagaagaattcattgcttttttacttcgttaccatacagcagtttgtataactgatattaattcagcattattattgtttttagatttatttcctgacaaaaatcaaagatacaagagaacaggagctgtattttttatattcatgtttacatccttaaggcaacatataacctggtatagaaaatgtatttttctataacttgaataaaattatgataggtaacttgattaaatcatctattttgaaatcaggttgtacagtcaggcttgacgttttatcttaaaaaataaccaaacacaagaaattttgtatagtaaaaatttaatgaaaaaggaaattaatatattggctaaatatgaagaacatatttgttatattaaccacaatgtaaaggtacacatgatattacataaaaaataatttaaataataaaaatagttaaataaataaatatttaaataaatagatgaaaggagacatcagcatggtcatctgtaaaggactagtgcctgcacaggtatacatgatgcttctttacactcctgaaaacatttgaaaattttgattcaacttgtggtggttataggagaagtgagtctttgaaatggaagaactcatgaaagtgtgagatgatgtattagtcaatgagaatcatttccatgatgaaccagttttcaatccttcctccttaatcttttttgcaagtttgttgaaaaagagagggatctcatgatttctgctctgacaacctcccaggcacaagggctgtatttcttctccatcagataaagagtgattctttggaagtatttcttcacagccaggatggagtcctcattcatcaggggagtctcttccaccccaacctcctgtatcacacaggcttccaggtcattcatttgctggaaaagttcaatgtagaatttttctaggagggtctcatcccaagcagcagatgagttctttgtgctgaagagattgaaggtctgctgcatcatctcatggaggacagagatggcttgagctttctggaactggttgccatcaaattcctcctggggaaattcaaagtcatgtctgtccttcaggcaggagaaaggagagattctcctcatttgtgccatgagcatcaaagtcctcctgttattcaggctgtgggtttgagacagattacagcccagagagcagcttgacttgcagctgagcaccaccagggccatcattaaagcaaagggcaatgccattgggaatcccgaagatgctgctgggctggttgatgaggggtaacactgaaccttgggttgtaggttttctgaagaccttgctctgtgcataggtcttaaataaggaacatactagcttccattttctgaacgtcttcatgtttttttctacttctcttttggctttcctttatgtcctgtctacatgggtgtagagcagtttctcaaccacttttattttcagtattacctcatctttccctgccccatgggctttttagaaatttctttctaattcaaagtcccattaaattttaataacacagacataccatatatttgttgatatactgtacatatctatttataaggagtgtaaagtttaatctttttatttaacatagtgttaagaatgaccaaatgggctgggcccggtggctcacacttgtaattccagcactttgggagaccaaggcagatggatcacgaggtcagcagttcaagaccagacttgccaacatggtgaaaccccgtctctgctaaaaatacaaaaattagtcgggcatggtggcaggtgcctgtaatcctagctactcaggtggctggagcaggagaattgcttgaacccgggaggcagtggttgcagtgagccaagattgcaacattgcactccagcctgggtgacagagcgagtctccatctcaaaaaaaaaaagaaagaaagaaaaaaagaagaccaaatgaaatttttaagctaaaagttaatagttaaatttaaaacccatggacatttaactcaatttgtttgtgtctttaaaatgatttatttacctatataaattgtaatgtgtccaattccatcagcaaattaacaaattataaaaacacataataatacctaatattataaaatacttaaaaatcatttaaaactgctaaagactactaaaatttaattttttaacatttacttttagtctaacttaattttctgtcatgttagaaaatgtttaacttcactagctgctagatattcatccagatattgtatagatttttttctcttcagtgcttgacataattattgatgtattgagcacctttagtagaattaaataataaaatataaagtatttgcatttaattctgaaagcccacagcacagtcagaaatgctaaggattaaacataagcaacattcacaagatggctaatgacagcccatatgtatacagaggccacctcagatgttatgactttgatgtctagtaaaccttagaaattcctccaatcacagcacccatttgacataggtttgtaacgctgatcttatataccttgtgtgtatcttccatgaactcaatgtcagtacttttcatgtgatacacaagataacccaatggaaaaaaagtactaaggaataaggttttgtcagatagagttgagttttagagtgctaccaatcaccgaaatacccaagatttgtcaacacactcaaaaataacttttacacttttgggagcaatatcatactgaaggagtatatgtagttaagaaaaagccattaatttgattaaacaaatttttggccctaaaattcaaatttccaaaggacctgcagatgttccaattctagttgatttttatcaaactaaaggaaaccctttttgtcctaaatgtccataatgggatgtaaatgtgataacataaatgtgttgtacaattgtttcacatgcaggacaccagaaacctttatttctcattttcattttcatttttattgaaaacaaaggttgtcactttttgcatcctaaagaactgggacaaaagaaaccccaaaacaaatgtatatctaaatgtgataaaaatgtaaaaaggaagcaatatattaatgggaaaaaaacaaggacaaaaagcaacttacgtacattcagcccagccaagttggagattaaggaatggggaagaacagaagcaggaaagtagaacggatgtagatcaaaggcagcaaatgggcatgggctagaagaaaagtaatcattcctgaacaagggtgtgttttctgcttttctgaatacagccttcacagagagtcatgggacacacaccaaccgctagagtttatacacaaaaaaggcaaattttaaagactacagtatattatccacataatgggtaagtgttatttcccaagctctcccttaatgtatacataaactcaagaggtcaatgtttttcttatcatgtctcttagaagaaagaaaggaatcgataatttcaaaggacacttctcccaacttaataatgtgtgtgttttcaaatttttggattttagcctttctaatatgtatgtagtggtatcccattattgttttaatgtgcaattccctaataatgtgtgatgctgagcatattttcatatgttatttgccatctttgtatctagtttgattaggagtatattcagaggttttgcctaatttctaattgggttgtttgttttcttattgctgagttttaagtattctttgaatatatatatatatacatatatatgtgtgtgtgtgtgtgtgtgtgtgttaatttttaatttttgtgggtatatagtagatgtatatatttaaggggtacatgagatattttggtacaggcatacaatgagtaataatttcatcagggtaaatggggtacccatcacctgaagcttttatccttcgtgttacaaataatccaattatactcttttagttatttttaaatgtacaataaattagtgttgactatagtcacaatgttatgctatcaaactagatcttattcatttctatataatggtatttttgtatcccttagcctttccctctttcctcctccactacccttctcagactctggttactatcattctactcactatttccatgagttcaattgttttaatttttagctcctacaagtgagaacatgcgaagtttgtctttctatgcctggcttatttcacttaacacaatgacttccagttccatccatgttattgcaaatgataggatatcatttttttaatgtgtcaattgtactccattgtatatgtgtatgtattatttgtatattttggataacagccatttgtcagatgtctttgcaaatatattctcccagtatgtggcttttcaaattctcatgacagtgtcttttgcaaagcaggagttttaattgtaataaaatccaatgtatcacttttttaaatgaatcatgcttttggtattttatctaaagttatcatcaaacactaggtcatctagatttccatgttttcaaaaggacacatttttgaaaaacatatcttcttttcttactaggtatgactcttacagttggtgccaatattcgtaatgcaaatcctagttatattcaggtataatgggtgtgggaatttcaattacaaaaccaacattatcttcatccttttcacagtaccatctcacctcagaatactgaggtttcacgtctctagtgacaccctctgttctgaagtgacaaaatgtagcttgattaatatgcatatagccatgtgtcctgacctccaactctccctgactcaaccccctttggtagggcatgggttaattctgtcagtaagatattcctttattgggtagtctcaagtgtccccaaaataatcccccaacattcttctcattgcctaagcactactcctatttaccaagtgtgaatataactgagaaagtagctaactgagaaagtagcgagatgtaaccttctctcctcctgacccaggtgtcaaatagtctgacagcctacacatgattccagcaaacattttttgtattcccatgctcccattaccagatatgcaataaagaatctcaatttatacctccacccatggcatttatcattaaatcttgacccacatacccaactgtcaatatgatttctgtactttcatgttttccaggcaccttagaaaggaaatttattatttttttccagcatgattcatacctaaaatttttgttatataaacatcattgtcctttacttctttttgtagtatttcatataagtgaaattaagtaaatattagtacagcttttatatttctttctctgtaataattcaagtttccacaaagaaggaagtgtattacctttattcacctgtgtttcctgacagcaattccataatatatcactttgctgacaaatttttacatatgatatgaagggaatgaaagaaaaagtaaatgaatattgtcattcattcttcatttgggtttagaaaaccagaatttggaatttatttttagaacaaaaaatccaaaaatttttctttactaagaatgtattaaataatactttttttaatcaaatgaaaagttgaacatgtattacacactttagtacaatgtaaaagtgaatatctattataggaaatagacaaatattagaaatatgacaagttgcaagagtaaatataaataatatagcaaaaatttgttctaagtaggtgggggaagtattcaattgccataattttaactttagtaagcaaataatttttattttgaaaattgtagattttattggtcaactcttactttcattcttcaatacttaaaactattgaacacttgcttgatttgacctttctgagctggccacaggggtgttaataatgttgataatgttgtctcttgttggcaactaatatgacagaaactaggactttcagttgtttatccagttagtgtttttcttggggttgtttacctgcatctctgccttactctgacagtacagggcaagttaggctccagactattctgtcaggaagaaataggcttctttcctttattggtttgtggttttttgttttaaatttgcttctttgcacatagtgattttctggacaaggtttgtcttgctgtttctgcattacattataattcatgatgaagtaacaaaaattaagagaagtaaaagtgaggcaaaggggccacattgtttttttctataatttccatgatttcatttttttttctcatttccactttcctagaaagcaaaacttgatagtagtttgtggtttacagaaaagtacaatgtcatgaaagtggaagaagagaagtgactttctgatgacacaatcaccaagtataaattagcaaaatataacgcagcaaaattggagactggggttctggcagagggcacgaatgaaggcccatattgaggtacacaaaggcagggaaattgctgcttctccaagaggctcagagaagagcaacttctgaagccatgaactgctctcagctttgcaagaccagccacctgacttttctgtgaattaatacacatttaaaaacatttcttgcattgtattatagtacacatttaaaatttttattgatacataatagttgtacatatatatggggtacatgtgctattatgataatgcataggatatacaatgattaagtcagggtatttaagatatccatcacctttagaatttatcattttttttgtgtgttgggaacatttcaaatcctctcttctagctatttagaaatgtataatacattgttgttaactttaaatactgtaccattgaatgctagaacttgttcttttcctctatgtgtccacatataatcagctctgaggagaaaagggaagagtgacaccaaccacctcctaagagatgggcaacaagacttcagttgctgcaacaccaatcctcttaggcaggataatggatgttagtctcgcctgagcactctacctagttaataaatctgctcaggcaatgaaaagattacttgtggaaatgcagaattaaaagagagggaattagatgcacccaaaagattctgcgcttaatctggattgtaataataatcatgatttgaaaatatgacatttagttttattgcatgcttagtatggatcatccactgttgtaaggtctttaaaaatactaactcaggcctaggacgtgggcacaaagctgctttgctagcctggggatgagcctgagagaggcagcccgaggggtgtttttcaggcccagggcccaggtgcaggtcatttaccctggtatggaggaagtcaaattgtctctgtttgcagactgcatgatcttatatatagcaaaacctgaagattgtaccaaagaatccttagaactgataaattaagtacgtttgcaagatataaaattaatgtacaaaaatcagtagtgtttctacacatgaaaaactagttgaaagagaaatcaagaagccattccattttcagtagctacaaaaaaaaaaaagagtaataaaatggctaggaataaatttaccaaggaggtgaaagacctctacaaagaaaactacaaaatacaaatgaaaaaaatggaagaggatacaaacaaatagaaatacatcccatgctcgtggattgaaataattgatattgttaaaatgagaatactacacaaagcaatcaacagattcagtgtaatccctacccaaataccaatgacatcttcacagaaacagaaaaaaagttctaaaatttgtatggaaccagaaaagaccccaaatagccgaaacagtcaaaaaaaaaaaaaaaaaaaaagaaacaaaacaaaacaaaaaaaccaagctggaactatcacactatcacacactactgggcctcaaaatagactaaaaagctgtagtaaccaaagcagcatggtactagcattaagaactgacacatagaccaatggaacagaatcaagaaaacataaattaattcacgaatctacaacaactaatttcttttttttcttttattattatactttaatttttagggttcatgtgcacattgtgcaggttagttacatacgtatacatgtgccacgctggtgcgctgcacccactaactcgtcatctagcattaggtatatctcccaatgctatccctcccccctcccccgcccacaacagtccccagagtttgatgttccccttcctgtgtccatgtgatctcattgttcaattcccacctatgagtgagaacatgcagagtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctatcgtgaatagtgccacaataaacatacatgtgcatgtgtctttatagcagcatgatttatagtcctttgggtatatacccagtaatgggatggctgggtcaaatggtatttctagttctagatccctaaggaatcgccacactgacttccacaatggttgaactagtttacactcccaccaacagtgtaaaagtgttcctatttctccacatcctctccagcacctgttgtttcctgactttttaatgattgccattctaactggtgtgagatggtatctcattatggttttgatttgcatttctctgatggccagtgatgatgagcattttttcatgtgttttttggctgcataaatgtcttcttttgagaagtgtctgttcatgtcctttgcccactttttgatggggttctttgtttttttcttgtaaatttgtttgagttcattgtagattctggatattagccctttgtcagatgagtaggtggcaaaaattttctcccattttgtaggttgcctgttcactctgatggtagtttcttttgctgtacagaagctctttagtttaattagatcccatttgtcaattttgtcttttgttgccattgctttaatttctaactaaggtgccagaaacattcactagggaaaagataatattttcaataaatggtgctgggaaaactggatatccatatgcaaaagaatgaaactaggcccctgcttctcaccctatacaaaaatcaactcaaaatagaacagagacataaatccaatgcctgaaactttatttatttatttatttagtttgagaccgagtctcgctctgttgccaagctggagtgcagtggtggaatctcagctcactgcaagctccacctcccaggttcacgccattctcctgcctcagcctcccgagtagctgggactacaggtgcctgccaccacgcctggctaatttttgtagttttagtagagacagggtttcaccttgttagccaggatggtctcagtctcctgacctcgtgacccacccaccttggcctcctaaagtgctgggattacaggcatgagccaccgtgcccggcccaatacctgaaactttaaaagtactagaagaaaacataagagaagtctgggaaaaagttttatgaataagaccacaatagtacaggaaacaaatacaaaactaaacaagtcacaacaaaaacaaaaataaacaaactgcaacaaaaacaaaaataaacaaattggattatatcaaactaaattttttaacaacaaaagaaataatagagtgaaaacaatctatagaatgggagaaaatattttgaaactactcaaccaacagggaattagtatacagaatatgcaaggaactcaaacaactcaagagcaaaaaagtaataataatgtgattagaaaatgggcaaatgatctgaacagacatttctcaaaaatagatatagatatggccaacaaatatatgaaaaactgctcaacatcactgtcatcagggaaatggaaatcaaaaccacactgagttatcattgcatcttagttagaatgcccattattcaaaagacaatgttaaaaatgctggtgtggatatagagaaaagagaactctaaactacctcagccaatgtggagaacagtatggaggtttctcaaaaagcgagaaatagaacaaccatatgatccagcaatcccagtactggccatttatccaaaggaaagagaattattatatctaagagacatctgcacccccgtatttattgtaacattattcacgatagccaagatacggaatcagctgagttctccaacaacagatgactggataaacaaaatgtggtatacgtatacatacacaatgacatactattcagccataaaaaaaataaaatcctatcactcgtggcaacatggatggaactggagaatattatgctaagagaaataagccagaaacagaaagttaaatactgcatgttttcactcatatctggaagctaaaataaaaattgatctcataaaagtaaaaagtagaacagaggatacttgagggtaggaagggttggaggaagagacgaattggagagatttattaaaagatactaaattatagctatgtaggaggttaaggtctagttttatataccattgtaggatatagttaacaataatatattatatagttgttaatagctagaaggaggacagtgactgttcccttcacaaagaaataataaatgtttgagatcatgaataagccaattaacaaaatctaattatttcacattatgaatatggaaatctcaccgtgtattccatgaatatatactattgttatttatcaattcaaatataaaaaaaacaaaaaaagttcaatactttcaacaaacctatttgtattatgctccttatataactctttggagaggaataacaatctggaaggatgaactattctgaacataccaatgatccaaggtcaaaaccttatggagagttgagctaattggtttgtatgaaagggcatgttacataagtgaagaatagatatgggaccaatgtacaggagcaacagtggtgttttatacgtgaatttaactgattggctttatattctaggtaggcaaaatattgtttaaatagctataagcaaggatttttttctcccaattgaaagacaaagtctaaggtttaatgtgtagtttcatcaaagaaatacaggaaaataactattaacttaccaattgaaagcctatttatttttaattctcgagattttttgtgagtttaagaataaacaaaaagcacctaacaattttcggtttgctgctagtggagccttatgggatctgtcttatctccttcaggacctcactaaatctacaggagagcttcttcaggctagcctactgttctcattcctaaaggtgacagcactgtttcttacctccagcccagactgaacttcatcttgtgtactgatagagtcttgtgaagaatctcttatcctctgtctttccaacaagtggttgagttttgagtgctgaaaaaacgttttgtcagatggaagaatattatgcagttcctatacagaagaagtgagggcttttgaagaggtgattaccaaagacagtctggctgtaactccaaacttagttcagctgcccaacatggttgattttatttaatttctagcctgatccaattaaaagccatgaaatacaacttagcaatgaaataaatatagcattaaaatcagcagtaattgacaaagtgataaaagcattagtattttttatcagaaataaaggatgatctttgcttgtcttttggacttgaatcctcagaaagtgtacaaatcctaactttgaatgtgcctattgagtatagaatacactgactggaaaaaagaaaaaagaaaaaagaagaaagagaactgacccaccaatgcctcttttcaattaatgaagttaaataaatacaattcggcaaagatctttgctgcctttagaagctgtgattcttcagccaggtgcagtgcctcacgcctgtaattccagcactttgggaggccgaggcaggtggatcacgaggtcaggagatcaagatcttcatggccaatatggtgaaaccctgtctctactaaaaatacaaaaattagctgggtgtggtggtgcatgcttgtaatcccacttactcgggaggctgaggcaggagaatcgcttgaacctgggaggaggagattgcagtgagctgagatcgcacgactgcactccagcctggtgacagagcaagactccatctcaaacaaacaaacaaaaaacaaacaaaagaatacaaaaaaaagagaagaagttgtgattcttcaatacatgcattattgatatctgtcctgctgggaagtctctggcccaattgaaatgtactcaaatacctgctgtgtcccttctgttcaggcattgtttcattttttactgcctttaaggaggctgcattatgactagaatttaagagatgccttgaattgcattggccccataaataagtttgcctgtagtgtgagaacttgatgggtactagggaggaaacaggagtttgcagctgacactgaagtaaccctgtcccttccaatactctacaggctgctgtagtatcagtgtcacccatgcaggggacagtgttggccatgtctccacgggagcactgtatgctctcagcatccacttcaatcttctctccctctgatttgaatattctgaacagttgactcagtgcttccattgctactccattttctgaggaccttccagtcttctctcctccttccaaattctaaagctgctgctggctctgtcttcatgtttcataatgtgggctttgcttttttcaacaaatgagagtcctgagcctggtggagtctcttcctagcggaatcagaatgttggaagtccctaaaaagaggcacaaatgagctcctgtattctttacccgctcattgggtgtagtgttgtgggcaggactctctctatttactgtgtttctgttcccagcaaaacatccttgacctctgcagtgctgagcttgccaggtaagggaaatctaggggtggttacattctttggcctcgtgagctcacaaagccccgttgtctccaggtggtactgtatcatgatctcttgtatctgttccaatggagtcagggcagggactaagcttccatgtgttcctcaccagaggaactgtccagggacttgtatgaggcaggctataatagggctcctctctgccagctctgccacttcctttcattgggtctccaatactttagaatatataaaaaattaacttctcgatatgttcaggatatagttacagacatttttcaggataaggtgacaatatgcagccacatcatacaatttttgcccactgaaatgataagcaacaaaaaacaaaaataacattaaagaaataagaagcttaaaagtagtcaggaataaaagggtttttaatatatgaaaggtgttaaaccatcaaagagacagaggagagagaaccaggtatattcaaaagtgttaatgttttctttctgatcctaaactgggccccccacactcagtagctaatgaaagagaggcaaagaacaaatatattgtaaaatataactttgaatttcccaatttctctcctcttccatttcaaaagagccatataaaggttgggtctgtaacttgagcaaagaattgagaaatctgtcctaagttgaagcctcttcctactaacctagcaattcacacatgcttcctggttaacttcttcaaatacaccatttcacagatcactttaatgtttccccaattctacccaaattgatacttctactgggtatcatttggcaagaattgtatcttctgatccctttacagatctctgttctctctcttactactgagtgaaaatagaagggatgcaagttgagtcattattgaaaataacagagaatgttctccttattatgaatgtaagtgacatgatctaaggaatgaatttgtaaaattagcaacttactattaagaaagagctaatgtaccttcaaacaggagattttaatggatgtccattacagttctacacccacattggcaggctgtactgaatcctagtgcagctcaatacataaaggagggatgagtcagggggctgaagtcaagggacacattcttaccctttctctctctacatagctgtccactgcccaaaggacatgtcctgcttgaagctgggagtactttccttctctatgataaaaaaaatgaaggaaatgggcttcttccaatataaggttcagctctttctgagaaagagtcctttttacctatgaagaaaattctgcaaagggacagaattctttatagaaaagaaaagctgactctccacagagttggtgtatgtctttgtcatcatggccagtaggtggctgtcatcctctgtaaataactgaacagcctccagagtagaataaatcttgacatttcctttttctttagagaaagttacatcattttaacaaaagtattcattcatttccaaaatttttcaccaggagggaaaaaaaaagacctctgatatggatgtttatgaaaaacctagaactctcacttaacttttgcttttatttgatgactttgtgctcttaggggaaaactgacagccaaaaaccacaagggaacaggaagcagctgtacgagtggcagtgcgggttgctggtgagtgaatgaggacagcacgctgggatttctacactggagagggaggaagctattgtgagatgggagtgaaagaattgaatcctgtaagcagagaggaagggagagtgtggcaggcatcagaatcagcaaagaatgctataaatatagatagctataaagcccatgctatttatatattatataatatatagtatctgaaacaagtatcagtctcttagactgatattcaatctcccagacttatatatagttagtctaggaggagactatatatatatatatatatatatatatatacacatacacacatcaggctacatttcccactaccattatcaagaactgccaaaaaatgtatagagtaccaatttacagatatatttataatacattagtctacgagactaattcctttatcagatatttacaagctgtcacattcttattgaataaaaaatcagtcagacttatctttaatgtcaagtgtatctaatattcatacttctctaagactgtcttcaattctctttttaggctctcagcattttccaatcagttatagagagggatgggagagttgactattctcagatagatctatatgaatgaatgaggaaatatccatcatctgttaagccgtgactcagtggaagataatctgttaagttcttttacatgttttagtttgtttgatattcacaactcctctagaaatctttctaccttactttacatctttaaaatttgaggctcagaggagttaagtaagttacccaggatcacagacatgtcctggcaaaatatagattcaatgcagaatcttaaattccatgttacaagtaattacttaagttttatattttgaaattcagatacaaattaatcaaaaaattgcacactattttgctttctgttttttagtcatagctgctattttagtattatttttgactgatttccatccaagtttgctccgtacttcagatattggggatgagaaatgttctgatctagtttcacttttctatcttatggagattccaagactgttatattcgttacaaattgattatttattactccctaagagtttataatttttatgaaatatcaccatacctatagtttaatctaatgtcaccatacctatagtttaatatcaccatacctgtagtttaataacaccatacctataatttaatcaggattaaaggacacagtggagaggaataactcttggcatttctatctctaccagaaatggaggagtgttttataataacagtgaaagcaatttgacaaagggtaagattaggcaaccagattgttaaaatatataatatctgaaattattttactatcatggtaataggatttaggagaaagtttgtatcaattttcaataaaatgtttatagggtgataatcaggcaatctaggtagatatcaatataaactctcatataagaaagtaaaatcttgatggaatacaggattgacttaagatttggttataaaaagaaaattaacacagtacaggtttcaggtatgatgcattaagaaggctggaccatgtcctactgcctttaacaagtacagaactgtcaaaaaatgtataaagtaccaatttacagatattggataatagtctactcagggctgtgacacaggagtaaagaataaaataactccttcagttcaaaaattaacctttcttccttccagaaagtttgggcaagggaaaaaatggaagcatcagggcttccagataaccagtccatgggtctgaggcatgcacttgatctctcaagtcaccttctcggccctcttctaagtgtactttatttcctttcattcctgctttagagcttttaaataaacttttactcctgctctaaaacttgcctcagtctctcattctgccgtgtgcccctcagttgaattgtttattctgaggaggcaagaattgaggttgctacagactcatgtggatttgctgctggtaacatactttggtgccgtgacttggatacattctgctaataacataatttgttgctgcgtgattcagatatgttccccagttgtaagatactgcgatggctcaccttctttggctggaggtgttaaaccccagtacatggttctcttctccctttttgctctaatgctcactaaccaacccctagaattacttttctcagccgcaagtggctgttcctctgttcctccagctgatctctcagctcaacctgatgggtggctcgcaggggtgtgaaggaccttggggttcacaccaagtagacctgagacactaaacatcttcctggacaggaggcttatgagagtggtatggtgaaatcctgagaccatgcaatgtctggggtttcctctgctttttcacctaaaatcagctctttcccccaaaccttaattgcctattctcctgttttctctgtgtatattctgaaatgaccttgcatatctctgaccatctgccttgggggaagtctgactttttgctttcactttgcatgccacataacttcttaaacacacactccttgttatttgggcacctgtggctcttgctgcatttgcgtgggagcaaaaacatgggctaccttgtggatatcctctgagatttatgtttgtttttaccctaccagctcagatgacctccaacccttcccctgtctgctggcacattgctgggacagacactaattggaactctggctctgtcggctacttatgacttaccatatgtttttgttcctgttatgccccagggacaagttttccagtggcccttgaagcaatctgtccacctgcataaggcctcactctgtggccccacttgctttttctgagttagcacccctttgggaggaggagatagtctttctttgtcatttgtgagttcttaccccaagctccaactcttctagaggttactactttatgtcaagagggcaaatagacattgccctcttgaatccaagggcttttggtttggggaacatacgaaggctttccatgagtgttcctctttcttcctcctatttcttcctgtagcctccatttctcaaatcactttcacacccttctcagtatgcttcaagacctttatggtcttatttgaagggtgggggaagtctagctcccttgtggcagttagctgaaaagcaggcttcttgtctacttgaacatgagaaatgggaatctgagaaaagaaataatcattttgttgataaaatgctctgagcaaaagttactataacatcatggagacaaggataggtcagcccaagagcccaggcacaagagacccataggacagagataaaggtttgccgcaggctaatagattaccatcagaacagagatgaaggcaaggttaggggtacatggtaagactggtttattctggaaccccaaggatgaacaggggagggtcctctcttcactctggtatctcctctgttctcaagtgggtcattgtaatgagatgggaccagggttaagggcacacagtaagaccagtttattccagaaccctaaggacaaatgggggacaccccattcagtataataggaaagtaataggggacaacttcttgttcctttttcctttttttctcctctgttctctctctgcaaatgggtaatcacatctccataccacagaacacacccttaggatgcatccttaagaactggaaaaagtttaattccctgaaactttgaaaccaaaatcctagttttccactgtaatactgtttggctaaaaatgaactcagagaaaattacaaaagtcagccttggaacccagtgcctctgtgcaggagatcctcaaattagcctcctcagtcttttataactgagatcaggacaaggaagacaagcctaaggaaaaagagaaatgcagggggaaaaggcaggctgaactattggctgctctgcaatagaggctggagctctccaactccctccaggttgccctaaggacattccttcacgtaactgccactggtgtggcaatccaggccactagaagacaaactgccccggtgggataaatgggaaaaagccatgtgcagcttgccctctctgccacaagcttggccactggaatgagactgccccaagggctgaagggtccgaggaagggatcccaacctttgatggccttgagccaaaggggctctctgctatgactggcttccaaatcagaaagcatcatcaacagaacaaagccaagggcaactctggaggcagaaagtaacattgtacatttcccttttgggttcaagagctgcctactctgtgctaatatccttctctgagcaactctcctccaaatgctactgagtaatgggaaaaaatggcacctccttcatccaaaagaaaagattcgcacctctttggggaaaaatatactttcaagttggatgcctacttagtatttacacaacttttgaattcatctttccttctaatagcactatttcttccaggaaagctacctaaaacatgaacaaattaacttcaacctggaccgtcttacctcagggtttagaatagcccacacttaggttgacgagccctagcaaaaattgaactgaacaatctcttgagtggagataacttctacagtatgtaaataacctcctcatttactcccccttcacagaactggcacagcaacatgcagtaaaatccttaactttctaatagaaggaaaatgacttgtctgattcaaaggttataaaggtaaagaggtatttctgggaaggaaggttataaagaaaatggattttgtatgagaaagaattttgtttggtaaattcttgtcccaaagtaaaataactggttgtttaaaaagaaagatatttaggacaagtcagaaagtccaagtatgtcataagtggcccacgttgtgaaaagattagtgaaaggaaatttatgaaagaaatcttgtacaatttaaaggttaataggcctgctaattaactgttactatgattcttaactatacaactacttgtctgctttaaagctaggtaaggcctggtgacagagttagccatgcaccctagctatactggagtcagaccttatctgcatttctgtctggtatcctaggctcaaaacctcatatataattagaattacttacttaccagctgataagatttggctgtgtccccactaaaatatcatctcgaattgtagttcccataatccccacatgttgtggaagggacccagtgggagttaattgaatcaagggggcgattacccccatgttgctgttcttgtgatagtgagttttcatgagatctgatggttttataaggggcttttcccctttgctcagcaattctcttcctgctgccatgtaaagaaggacatgtttgcttccccttccaccatgattgtaagtttcctgaggcctctcaagccatggtgaactgtgagtcaattaaacctctttcctgtataaattactcagtctcaggtaggtctttattagcagcatgtgaacagagtgatacaccaggttttcataaaaagtttctaagagttaaacagtgtaacatgtatttgagactacttgaaaaacagttttacgtgcaaggtacgtaaggaaagtcaaatgtgcttttggtaaaagattataaaaaggcatgggaatgtggatttttgtcttgtttagaggatttaaggattgttttaatttagataggataaagctaaaggtttaaccaagttgtggaaggtttctgaaatattaatcttgcagaagaaattctgtgtgtaatcatattggctaaagttaaaggggtattattcaattttcatttaaattgagcattaaaataaaagcaaacagttttattaaagcattaatctgccctttatcaatgtgctattggtgtgtgttccaaaattacgtaaaactcctaatcccttttttttttttttttttttgagatagagtcttactctgtcacccaggctggagggcagtggtgtgaccttggctcactgcaatctctgcctcctggttcaagcaattattccacttcagcctcccaagtagctgggactacaggtgtatgccaccacacccagctaattttttgttgttactgtccttttttagcagagaatgggtttcaccatgtttgccaggctggtctcaaatttctgacctcaagtgatctgaccacctcagtctcccaaagagctgggattacaggtatgaaccatcatgcccatcctgaaactcctaatttttatataccttagtatacattatcagtaatttttccctcttgttataaagaataaaagtaattttattttgccaaatgttgatgtctatgttgagattaattcattaaatcattgaacacttcttatgcttcaagttgctgagctggtcacaggggattcaacgaagattgaaggtgtttgttagtcacacattattaacacttacaaattaatcctcatttcatctgatgagggatatctgcatttttcagatgacagggtctcattattttttatggttgaatagtactgcattgtgtgtatgaactacatttcctttaccattcatctgttagtggacacttaggttatttccaaatcttagctgttgtaaccagtgctgcaacatagtagtgtagatatctcttggacatactgatttcctttcttttgtgtacatatacagctttgggattgctggatcataaggtggcctgatttttagttttctgaggaatgttcaaattgttctccatagtggttgtactaatttaaattccaatcaacagtgtacgagatttcccttttctccacatcctcatcatcacaaattaaaaatttataaatacacatttataacactgatacaatggtagacttaaaagtcattcaaaaccttttttaaaacttgaaaaattatttcctgaacatggataaatgaaactacatcaaaattaaaaacttctgtgtctcaaagatacaatcaaaagagttaaaaaggcaatcttaaaaatggaagaaaatatttgcaaataatacatctaataaggggtaatggccagaatctataaggaacttctacaatcaacaacaaaaagcatttaacttaatttaaaaagggaaaagatttgaatagacatttatttaaagaagacatacaaatgaccaactagtatatttctatggtctgaatgttcctcctaaattcttatgctgaaatcctaacactgaagtgatggtattagaaggtaggcattttggcagcagattaaaccatgagggcagatccctcattaatgggattagcacccttataaaagagaccccagagagccaactttccttccagcatgtgaggatacctcaagaagacaccatcatttgagccaagaaatgggccctcagtggattcagaatctgcaggggccttgatgttggactttccagcttccagaactgtaagaaataaatttctcttatttgtgaattaccaagttgatggtacttgttatagcagctctaacagactaaggcacatatggaaagatgctcaacctcactaactgttaggggatacaaatcaaaatcacaatgagatatcacttcacatccatcagggtggttagtactttaaaaaacaccccaaataacaagagttggcatgatgtagagaaatggaaagacttgtgccctgtttgtgggaatataaaatgatgtagcatagttgtaatggaaaacagtgtgatgttccttaaaaacttaaaaatagaattactatataatccaaaatttccacttctgggtatatatcccaaacaatttttcaaagcagggtttgaagaaatatttatataccatgtttataaaagctttctttactgtagccaaaaggtagaagtaatccaagtgctcatcaatggatggatgaatagataaataaaatgtagtgtatacatataatggaatattattaagccttatatgcattccattaaacacatcatggaatattattcagctttttacaatggagtattatttttcataatattattcagtaaaatgtggtatatacatataatgaaatgttattcaatcttattctgacacatgctgcaacatggatgaaccttgagtacattatgctaagtgaaataagccagtcacaaaatagcaaatactgtatgattgcacctatatgaagtatctagagtagtcaaattcataaaaacagatagtagaatagtggttgccagaggcttagggatggcaggagctggaaggagtggagagatgttatttaaggagcatagaatttcagttttgcaagatggaaaagtctggagattagttccataatgctgtgaatgcagttaatactactgaactgtataccaaaaaatggttaaggtggtaaattttctgctaactgtactttatcttaattttaaaaataggtaacaagggcaacattattccttggaaaacaatgctaaaatataacttagctaaattcagcccagccaagcagtgattaaaggatgaggtagaggggaatcaacattggagaagggatgtagaccaaaagcagcagatgggcatgggctcgaggaaaagtcatcattcctggtctaggggttggctttcagatttgattattctaggcttcagagttaagaaggacataaccaagtcacaagagtttatatacagaaaggtaaatttttgaaagtacagtattctctgtggataataggtaagtgttaattgcactaagttctttcctagtggattaatatatccagaagatcaataatttccttgttgtgactgtcacaaaaagcaaggaaatacatgatttcaaacaatgcttctcccacattgtttaacttaacagaattaaataacgagaatagtgttaatacgaagaatgaaatagctaaattctagaaaatgtttattgtcagtcacacattgttaacacttacaaattaatcctcatttcacctcatgaggaatacctgcatttttcatatttattgaatgtgtaccagtggccaattccatttagtccctatagatatcagtgtctctgatggttaattttaggtgtaaacttgattgcattaggaatacctagcaattttggtcaagcattattttggggtgtatcccagggtgtttccagaggagattagcatatgtgtcttaatgggctaagtggggaagatccaccttcagtgtgggtgggcaccatgtgatctgctgggaatctagagagaacgaaactgataaaagacagatgcgtggatctatccactgaaaccatgatgcactctttctcccctgtccttcaacaacaagtccaagctccccgatctttggactccagggcttaaaccagaagcccttcggttctcaggactttggcctgggactgagaatttcattatccacttcccttattctgaggccttcagacttgaactgagccacactaccagcatcctagggtctccatatttattatatgtaattattatatatatttattacatctatatacatatatatactgattttgtcttgctggagaaccgtgagtagcacagtgaccaaagcggacagtggtaagttatattattattcctatttacagaagaaaatacagaagtatagggagttattgaattgtggagccactgttggaatgcagaaaatctgactctgaatcctcagctcttacatgctcttgggacatgttttggtcaaaagaaccagaggtgatttctagactgatcaatgcttttccagtagagtcctgcctaaggaataaaaaagtcattctcttcagctgttatgcttcttcactgtaaagtcccatttgcttatgccagatgtgtttcataatgaatatattgagccctattttacttacacatgttctatcctagttttgtctccttgagaatttatctttataaattcaaatacatttgaaaaataatttgttcatcccagtaatatacacaacataatcatggtacaattattcaaacaaataaattaacattgatattatattaccatctaaactttagatttcatccgtttttttcattaacattatttttctgtttcaagaatcaatccaggatcccacactgcatttatttgttttatttctttagtctcctccaatctataacacatgctcagtctttcctagtctttcattatcttgaggcttttaaataaaattgatcagctgttttgtagaatgtccatcaatttggatatgtgtggtattttctcatgataacattgaatttacagatttaagagaagcataccccatcattgccaagatcttggcctgcctgcctatgtgtacaaacatgtatgacctacccaggcacagagacaaaagaagctctttcccctggtcccagagtgcacattcagttcatttgtgcatatacccatgtctaggtgtcttgatggctattgagggagttggtgtggtaccctagtgctattagtgcaggacacagcttgcttaacatggaatcacagcaacccttttaaaaggcataggtggaatttccattcacataaggtttgtgtttgcatgtgtttttgactttttaaagacttaattgtcacaagtttcatgattaactgtcacaggctgctatataacaaaactttagctactcacattcatgcctaatagttctaatatattatttatctaggtttgatatccttgtttcatggaccctgttagagcaaactaaatacagcttgagaaggactccatacttctatatttaagtccttgtggatgaactgcaacctaatttaataggtagacaagattgaaaacctaacttaagaatatgagtctgtatcaatagctgagtcttgaccaatcccagcagccatacctcaaccagtcatacactgctgagtgttcaaactgtgttcaaataaggcaaatgccaagctgtaaccaatctagctgtttttgtagctcacttctgatttctgtacgtcattttactttttttgtctataaatttgttctgactacaaggcaaccctggtgtctttctgaatctgctgtgattctgggggctacccaattcatgaatcgttcgttgctcaattaaactcctttcaatttaatttggctgaagtttttcttttaacaaccttaatcctcaggaagggtttctaattctaaatgtaactacttagtgcaaagtgcaccaactggaaagaaaataaagataattaaagtgtcattgtcttctcaactaagttaaatgaatgaattttgcaaaggtctttgctgcattcgaaattgtgatcttgcaatgtctacattaatcacatctttccttatgggagatacctgcctttatgtcttctgttcaggtgttgtttcattttgttttgtttttaaacgaagtctccattgtgaccagaattcatgagatgtcttggatttcattggccctatgaataatttttcctgcactgtgataacttactgagtcctagggaggaaacagaattttacagctgacactggaataacccttgcccctttcaatactctcagtctgctgtggtatcagggtaacctatgctgaagacactgatgttggccacatctccatgaggaaactctgtgctcttagcaaccactttaatcttctctcctaattgcaatgatctgaacagttgacttagtgctcccactggaattgttccagctcttgagtaccttcttcaagttaatgttgtgagctttagatttttaaacaaatgagagccctgggtcttctgcagtctcttcaagtggaattagaatttggaaacttttgaatagaagcacagatgagtttttgcattcctaccagctctttgggtgcagatctgtgggcagggtgctttccactaaccatggttgtgctgaattggacttccttgggttgtaacccttgtagctcatgaatcacctggcaggaaggagaagcaaagccatgctcaccccttgccctgaggcttcagaaacttggctgtctccagctggtgctgcatagtgattgatccttagccaagtcttcctgtgcaccagggggctctccatgccctttttaggtttactagatgcactttacctggggtgggggtggaggaagtaaagtgaagttcgcagcaggacctgggggcaagggtcagccacctcagtgctcatgcactccattgcactccctgcccaggttcctccagatttgccactcagttccccaatactgtagcatatataacatgtaaattataaacataaaattataaggcccccaaaccacctgaatgaacttcctcctctgacagggtattcttaaaatttaacctgaaagactggttcaggcatgacagttggacatgcttcattggaactctccctggcattaacatcaacacagaacttaagtctcataagaagcttttacaatctattctctctgaagcctgctacctggaagcttcatctgcataaaattttggtctctacaacttattgcaacccaggctttcctttctattaataataactctttcaaccaattaccagtcagaaaaattttaaatctacctataacctggaagcccccatgcttcgacctgtcccacctttctggactgaaccaatgtatttcttaaatgtatttgattaaagtctcatgtctccttaaaatatataaaaccaagctgcaccccaacctcctcgggtatatgttcttgggatctcctgagccaagtgtcacaggcaatggtcactcatatttggctcagaataaatctcttcaaatattttatgaaatttgactcttttcattgacaatagctccaggatataaaaaatatatggctgtagcttactgttccaggacaagatatcagtgtggagccaagtcataaaaaatttgcatccagaaaatataatgaaagtaagttacattaaaaaaacaacagcaaccaaataatggaaggggttatcacatttgaaatgtgttagggaatcacaattgaaaggtgttagggaatcacaaagacagagtcaggtttatcaaaaaatatgcatgtcaccctgctcctatcctggtttcccaacaagtgattgaagaggaaagaaaagataggaacaaacattgtttaatatgtaaatcagagcactctaacccatcaataggagaaaaggaatttaaaattgggtctctaatctgaggtagagatttgagcgatctctgcgaagttgaaaccctgcgttactgtctggggaattcacacctgggcaatttacacacacttactgattaacttcttcagttaacaattttgagcagattacctcagtatgcttcaattctacccaaataggtagcaaacaggtgtcaattgggagtcattatagtctctgaaatctctttacttatggcagtgctctaactcagagtcaaggtggaattgatccaagctcatttgttattcaaagtgagagtgagaattttctcatgatagtaaagtcaagggacagaatctgagaataggaaagaatttctaaaactgacaacttacttgtaagaaagagctaatgtgccttcaaatgagattttttttcctgatttccattggagttctgcacccagattggctggctgtactgattccttatataacagaatacatagagggagggatggaacaggaggcccttggaggctggccaggctggaggtaaggaacacatcctgacccttttttccccacatagccatccattgccaaaaaaagttaaaatgtgcctgaggctgggagtattttctctaagatacaaacattaagaaaaagtgcttattcccatactggggtcagttcctgacaggaaagagcctctttttaactctgaaatgaaatctcctgccagggacacacttctgcataagcagaaaagctgctcctcacagacttggccgctgtcttggtgcattttggtcatcggtggctctcttttcctgtaaatgttttaacagcctcagagtaaaatggagcctattgtggaagactgagtgctggtggcatggggctcaaaggatttaccaagacagttgtaggtaaaggaaggcagaaaatttattaggaaaatatgttgccagagagacaacaggcagccagtggaagagaagctgactgccaggagagaaaggcttgctggagattttataggataaaatctatgctgtctgttgaagagggctttgtgtggtattgataacacaaaggttgcagtgagctaacttgcagatgtctactgatagctgggtacagaaatattatgaatgatttgagcaggaggactgtgtgtcccagactataaagaaaagcaagcttgttttctacctgcttcctctttttgctttctcctgctcccaccagccctactcttttttccgaattaagactccacagaacctgccttttatttcccctttgcaaagctactgttacatcattataaaagggacattccctctttttccagaaatattcctaagaaaagaaaaacagcctgttatataagagtgtctgaaaaaactagaactttcactcaaggtcggctttaatttgcagttttgtattcataaggggaaagtgatgggcaaaccccacaagagaacagaaatcagctgtgtgaataggcactgcaggctaatgaagagtgaagaggagagcacagtgggaatttctagaggaagagaaaggaatctaatgtgatatgggagtgaaaaatgggatccagaaaagcagagaggaaatggggaagtggaccaggtctcagaaccagcaaaggctactatgtatatttcacttagtttaggagactaacttcatatgggagcgtatgctggaattctgagagccagaaaaggaacgtgccaggtgccagaatcagttaataggcattatgtgtcttctgcatttcaatctacatgctgcttcttttctttcaggtattcatacaaaccaacatttcctgactgaatgcaaataggacacttctttgaaatgaggagcgacaaatttttaacctttctagaattcatgacagaatactgttttttttttttttttaacgctgtctccattgaaagtcagttactgaatggtaggacacaattcttatgaattttgtagaaagacaaataatattctcatctacaactgtgtgaagaaaaatagaaaaatacttgccatgtgttaaatccttacactatggagaatactatgcaaactgctttcaactgcctgcgttcatttaagaatcacaacaactatgtaagtatttctaatcctttctatttataagaaactgaggctcagagatattaagtgctttttttcaacatcacacatacatgcaaacagagtgaaatttcaatgttaaattttttattgttatttacaactaatgtgtaagctttgtattgggaatttctgcaataattttaactctcttttgattcctggattatacacaactctctcctgctctctgtatatccttggttcatgttgtattttcggctgattttgaccaatcttttattttattttgtatttttatttattatttacttattttttgaggcagagtctcactctgtcacccaggctggagtgcagtgacgctatctgggctcactgcaagctccgcttccagggttcacgccattctcctgcctcagcctcccaagtagctgggactacagaaacccgccactacgcccggctaatttttttgtatttttagtagagaaggggtttcactgcgttagccaggatggtctcgatctcctgacctcatgatccgcccacctcggcctcccaaaatgctgggattgcaggcgtgagccaccgcgcctgggccctatgttttgttttgttttgttttttattattatactttaagttctgggatacatgtgcagaatgtgcaggtttgttacataggtatacatgggccatggtgatttgctgcacccatcaactcgtcgtctccattaggtatttctcctaatgctatccttcccctagcccccacccccaacaggctccagtgtgtgatgtttcccttcctgcgtccacgtgttctcattgttcaactcctatttatgagtgacaacatgtggtgtttggttttctgttcctgtgttaatttgctgagaatgatggtttccagcttcatccatgtccctgtaaaagacatgaactcatcctttttatggctgcatagtattccatggtgtataggtgccacattttctttatgcagtctatcattgatgggcgtttgggttggttccaagcctttgctattgtgaacagtgttgcaataaacgtatgtgtgcatgtgtctttatagtagaatgatttataatcctttgggtatatacccagtaacgggattgctgggtcaaatggtatttctggttctaggtccttgaggaatccccacactgtcttccacaatgtttgacctaatttacactcccaccaacagtgtaaaagtgttcctatttctccacaccctctccagcatctgttgtttcctgacttttttaatgattgccattctaactggcgtgagattgtatctcactgtggttttgatatgcatttctctactgaccagtgctgatgagcttttttttcatgtgtctgttggctgcataaatgtcttcttttgcgaagtgtgtgttcatatccttcaccccctttttggtgttttttttttttttttttttttttttttgtaaatttgtttaagttccttgtagattctggatattagctctttgtcagatgaatggattgcaacagttttctcccattctgcaggttgcctgttcactctgatgatagtttcttttgctgtgcagaagctctttagtttaattagatcccatttgtcagttttggcctctgttgccattgcttttgatgttttagtcttgaagtctttgtccatgcctatgtcctgaatggtatcgcctaggttttcttctagggtttttttggttttaggtcttacatttaagtctttaatcgatcttgagttaatttttgtacaaggtgtaaagaaggggtccagtttcagttttctgcatatggctagcaagttttcccaacacaatgtattaaatagggaatcctttccccatttattgtttttgtcaggtttgtcaaagatcagatggttgtagatgtgtggtattatttctgaggcctctgttctgttccatggttctatttatctgttttggtaccagtaccatgctgttttggttactgtagccttgaagtatagtttgaagttaggtagtgtggtgcctccagatttgttctttttgcttaggattgtcttgactatatgggctcttttttggttccataagaaatttaaagtagttttttctaattatgtgaacaaagtgaaaggtagcttgatggggatagcatctataaattaccttgggcagtatggccattttcacactattgattcttcctatccatgagcatggaatgtttttccacttgtttgtttcctgtcttattttgttgagcagtggtttgtagttcttgacgaggtcctttccacttgtttgtttcctctcctatttccttgagcagtggtttgtagttctccttgaagaggtccttcacatccattgtaagttgtattcctaggcactttattctctttgtagcaattgtgaatgagagttcagtcatgatttggctctctattattggtgtataggagtgcttgtaatttttgcacattgattttgtatcctgcgactttgctgaagttgcttatcagcttaaggagattttggactgagacaatagggttttctaaatatatactcgtgtcttctgcaaatagagaccatttgacttcctctcttcctatttgaacactctttatttctttctcttgcctgattgccctggacagaacttccaatactatgttgaataggagtgatgagagagagcattcttgtcttgtgccagttttcaaaaggaatgcttccagcttttgcccattccatatgatattgactgtgggtttgtcatgaatagctctcattattttgagatgcattccaccaatacctagtttattgagagtttttagcatgaaggggtgttgaattttatcaaggccttttctgcatctattgagataatcatgtggtttttgtcgttggttctgtttatgtgatggattacgtttattgatttgcatatgttgaaccagccttgcatcccaggaatgaagccgacttggtcttggtggataagctctttgatgtgttgctggatttggtttcccagtattttattgaggatttttgcattgatgttcatcagagatattgacttgacatttctttttttttgatgtgtctctgccagtttttggtattaggatgatgctgacctcataaaatgagttagggaggagcccttctttttctattgtttggcatagtttcagaaggaatggtaccagctcctctttgtacctctggtacaatttggctgtgaatccgtcttgtcctggactttttttgttggtaatctattaattactgcctcaatttcagaagttgttattggtctactcagggattcgacttcttttttttttcaattttttttttattatactttaagttctagggtacatgtgcacaatgtgcaggtttgttacatatgtatacatgtgctatgttggtgtgctgcacccattaactcgccatttacattaagtatatctcctaatgctatccctccccactcccccaaccccacaacaggccccagtatgtgatgttccccttcctgtgtccaagtgttctcgttgttcaattcccacctatgagtgagaacatgcagagtttggttttctgtcctagcgatagtttgctgagaatgatggtttacagcgtcatccatgtccctacaaatgacatgaactcctccttttttatgactgcatagtattccatggtgtatatatgccacattttcttaatccagtctatcattgatggacatttgggttggctctaagtctttgctattgtgaatagtgccacaataaacataagtgtgcatgtgtctttgtaacagcatgatttataatcctttgggtatatacccagtaatgggatggctggttcaaatggtatttctagctctgatcgccatgctgccctccgcaatggttgaactagtttacagccccaccaacagtataaaagtattcctatttctccaaatcctcaccagcacctgttgcttcctgactttttaatgatcgccattctaactggtgtgagatggtatctcattttggttttgatttgcatttctctgatggccagtgatgatgagcattttgtcatgtgtttgttggctgcataaatgtctttttttgagaagcgtctgttcctatcctttgcccactttttgatggggttgtttgatttttttcttgtaaatttgcttaagttctttgtagattcttgatattagccctttgtcagatgggtagattgcaaaaattttctcccattctgtaggttgcctgttcaatctgatggtagtttcttttgctgtgcagaagctctttagtttaattagatcccatttgtcaattttgacttttgttgccattgcttttggtgttgtagtcatgaagtccttgcccatgcctatgtcctgtatggtattgcctaggttttcttctggggtttttatggttttaggtctaacatttaagtctttaattcatcttgaattaatttttgttctgccctctcttaccactcctattcaacataatgttggaagttctggccagggaaatcaggcaggagaaagaaataaagggtattcaattaggaaaagaggaagtcaaatcgtctctgtttgcagaagacatgattgcatatttagaaaacccaaacacttcagcccaaaatctccttaagctgataagcaacttaagcagtctcaggatacaaaatcaatgtgcaaaaatcacaagcattcctgtacaccagtaacagacagagagccaaatcatgagtgaactcccattcacaattgcttcaaagagaataaaatacctaggaatccaacttacaagggatgtgaagcacctcttcaaggagaactgcaaaccactgcttaatgaaataaaagaggatacaaacaaatggaagaacattccatgctcatgggtaggaagaatcaatatcgtgaaaatggccatactgcccaaggtaatttatagattcaatgccatccccatcaagctactgatgactttcttcacataattggaaaaaactactttaaagttcatatggaaccagaaaagagcccgcattgccaagccaatcctaagtcaaaagaacaaagctggaggcatcacgctacctgacttcaaactatacttcaaggctacagtaaccaaaacagcatggtactggtaccaaaatagagatatagaccaatggaacagaacagagccctcagaaataataccacacatctacaaccatctgatctttgacaaacctgacgaaaacaagaaatggagaaaggattccctgtttaataaatggtgctaggaaaactggctagccatatgtagaaagctgaaatgggattcaacttcttcctagtttagtcttgggagggtgtgtgtgtccaggaatttatccatttcttctagattttctagtttatttgcacagaggtgtttatagtattctctgatggtagtttgtatttctgtgggatcagtgatgatatcctctttatcattttttattgtgtctatttgattcttctctcttttcttctttgttagtctggccagcggtctatctattttgttaatctgtccaaaaaaccagctcctggatttactgattctttgaagggtttttcgtgtctctatctccttcagttacactctgatcttagttatttgttgttttctgctagcatttgaatttgtttgctcctgtttctctagttcttttaattgtgatgttagggtgtcgattttagatccttcctgctttctcctgtgggcatttagtgctataaattttcctctaaacactgttttagccgtgtttcagagattctggtacactgtgtctttgttctaattggtttcaaagaacttatgtacttctgccttaatttcattatttatccagtagccattcaggagcaggttgttcagtttccatgtagttgtggggttttgagtgagtttcttaatcccgagttctaacttgattgcattgtggtctgagagactgtttgttttgatttccattcttttgcgtttactgaggagtgttttatttccaattatgtggtcaattttagaataagtgtgacgtgatgctgagaagaatgtgtattctgttaatttggggtggaaagttctgcagatgtctattaggtctgcttggtccagagctgagttcaagtcctgaatatccttgttaattttctgtcttgttgatctgtctaatattgacagtggggtgttaaattctcccactattattgtgtgggagtctaaacctctttgtaggtctctaagaacttgctttatgaatctgggtgctccagtattgggtgcatatatagttagaatagttagctcttcttgttgcattgatccctttaacattatgtaaagcccttctttgtcttctttttctttttgatctttgttggtttaaagtctgttttatcagagaccagaattgcaaccccagctttttttttttttttttttttttttttgctttccatttgcttggtaaatattcctccatccctttattttgagtttatgtgtctttgcatgtgagatgggtctcctgaatacagcacaccgatgggtcttgactctatccaatttgccagtctgtgtcttttaattggggcatttttcccatttacatttaaggttaatattgttatgtgtgcatttgatcctgtcataatgatgctagctggttattttgcccattagttgatgcagtttcttcatagtttcaatggtcttcacaatttgatatgtttttgtagtgactggtactggtttttccttttcatatttagtgcttccttcaggagctcttgtagggcaggcctagtggtgacaaaatctctcagcatttgcttttctgtaatgaattttatttctcctttgcttatgaagcttagattgactgaatatgaaattctgggttgaaaattcttttaagaatgttgaatattgggccccactctttactggcttgtagagtttctgcagagagatgcactgttgatctgatgggcttctctttttgggtaatccgacctttctctctggctgccctcaacattttttccttcatttcagccttggtgaatctgacgattatgtgtattgagtttgcttttctcaaggagtacctttgtggtgttctctgtgtttcctgaatttgaatgttgacctgtcttgccaggttggggaagttctcctgggtaatatcctgaagagtgtttcccaacttggttccattctccccttcacttttaggtacacgaatcaaacgtacgtttggtcttttcacgtagtcccatatttcttagagtctgttcatttcttttcattcttttttctctaatcttgccttcacactttatttcattaagttgatcttcaatctctgatatcgtttcttccacttgattgatttggctattgatacttgtgaccaatctttttttgttttcttaaagcgttgagaaagcgattctttcatccagttttccattttattttatgaaggaagtttgtcaggttttactgacaattaacatagtactaatcaaaattataattattgcaactttatatgttataatttgatattataaaatattaagtatattaacagcttttcaatgcatgaaatcaatctgcagacatatatattttcaaacggataaaccatgcaggtaaaatgaaatgtgatccactttttttttcatgtctaaccttatttctttcctttatcttaaagggaaacctctcacaactatttcttatctattttgtcacagatttcccttctttgattcatgcttccacctactgcaatacggtttatagtgattaattctaccaatgcagctctcactaagatctccactgccatttatttttctgatgtagtggacagttttaatccatatttcccccaagtctattgattcttcttctaaatacatttattttcaagacacacatttatcaccattaagtctttccttcactaatgtacagttttccacccttgcttcctttgtgtctcttatatcccctctctttaaaggtggaaggtcctcagaatcaattttaggttcttttttcctttacttttctttttcctctccacatgactgcctctatttttgggctttccattgccagttatgaaccttcaggcattgtatttcttgaaaattgcaaattcatatatctgactggaaatacacatttgcaattgtatgtttagaagtcaatttattgaggatattgcttcttttatttttatttctggaatgcctaaatccatcctcttctatgagaaattcattgttttttttttcctatctcacattatagcatttaacataactgatatcaattgagaacgattattgtttataagtttctttcctcacaaaaatcaaaggtacatgagaacaggaaatgtatttgttttttcaattttatatcctgaaggcaacatacaacatacaatctggtatagaaaaatctattttgacttataaccaataataggtaactgaatcgtataatctattttttaatcaggttaaataatcaggcttggagtttcattttaaagaataaacaaatacaaggagttttccatagtaaaaatttaatgaaaaaagcaaagtaatatattgactaaatataaagaacatgtattgttatattaaccacaaagtaaaaatacatgatacatgaaaagaagattttaaatagtataaatagttaaataattatttagacaaatagataaacagatccatcagcatgatcatccgtaaggaactagtgcctgtacagctgaacatgatgctgcttaacattcctgaaaacattttaaaattttgattcaactcatgtcatggatatagcaaaaatgagaaatggcagaattcatgaacgtgtgagatgatgtattaatcatggaaatgtttctcatttccatgttgaaccagttttcattccttcctccttaatctttcctgcaagttcgttcataaagagaaggatctcatgatttctgctctgacagcctcccaggaacaagggctatacttcttctttgtcagataaagagtgattctttgaaagtattttctcacagccaggatggagtccacattcctcaggggagtctcttccactccaaccttctacatcacacaggcttccaggtcattcagctgctggtaaagttcagtgtagaatttgtctaaaagggtcgcatcccaagtatcagatgagtcctttgtgctgaagaggttgaaggtctgctgcatcatctcatggaaaaggaagatagcttgaaccttctggaagtggttgccatgaaacacctgatgatggaaaatcaaagtcatgtctgtccttcaagtaagaaaaaggagagattctcctcatttgtgtcaggagtatgaaggccctcctgttacccacgctgtgggcctgaggcagatcacagcccagaggcagatggacttgcagctgagcaccatcatagccatcagtaaactaaagggcaagtccattggggatgtttcagatgctactgggctggctgagagagtgactctgaactctggattttaggttatctgaagaccttattttgtacgtaaccttaaatagggaacacactagtttctattttctgaatgccccctctcttattttctatttctgtttttgttttcctttatgctctctctacagggctgtagagcagtttcttaactacttctttttcattattacctcctcttctccttccccatagtctttttagaaatgtctctgtaattcaaattcccactaatatttaataacatagatatactatatatctgctgatgttctatgcacacatctctatatataagcagtataaagtttaatgtttttattcaatggagggttaagaatgactaaacattttaagctaaaagttaatagttaaatttaaaacccatgaatatttaacttaactccatatctaaattttaaagtgatttttatataatttattcacttatataaattgtaatgtgtcaaattacatgaccaaattaacaagttataaaaacaaataataatacctaatataataaaatacttaaaagtcattcaaacctgctaaagacttaaaatttaaattattttttaacattaactgttagtgcacttaacttttaattttgcttcatggggaaaacttttgacttcagtagctgctagatattcatccagatattgtcaagattgttctcttttcagtgctgagacaattaatgatgtgttgaacaatatcagtataattaaataatataatataaagtatttttaattctcaaagcccacaacacgttcagaattgctaaggatcagacataagcaacatccacgagatggcaaatgacagcacatatgtatgcagtggacacctctcatgatatgacttagtcatctagtaaaccttgaaatgtcctctactcacagcacccatttgccataggtttgcagcactgatcttatataccttttgtgtatcttccatggactcaatgtcaatgcttctcatgtgatacacaagaatactcaattaaaaaatgctaagggataagttttttttcagatagagttgagctttaaagggccacaaaccattgaaataggtaagatttgttcctgctcccaagaattaacttattgttcctttgagagcaatatcatacccaatgagactacacaattgagaaaaaatcagttggattaaaaaaatttgtacattaaaattcaaatttccaaagaacctgcaaaggttccaatactagttgattcttatctaactaaatgaaacaatttttgtcctaaatgttcatgatgggaggtaaatgtgataacatatatgggctgtacaattgttttacatgccatgccagacaccagagatatttgtttctaattttcattttcattgaaaacaaaagttgttacttttgcatcctaaagaatggagacaagaagaaaacaaacgtgtatctaaatgtgattaaaatgttaaaaggaaaaaatatcttaatggaaaaaaataatgatgaaatagaatttacctacattaattccagtcacgatggaaattaaaggaaggggaagagcagaagcaaaattgtggaagagatgtagatcaaagggagcaaatgagcatgggctggaagaatagtaatcattcctggtcaggggtgtgttttcagctttgctgaatccagccttcacagagagtcatgggacacacaccaaccacaagagtttatacataaaaaaggcaaaaatttgagagtacaatatactctctgcataataggtaagtgatgatgtaccaagttctcccttagtgtataaataaactcaagagatcaatatttttcttatcacatctcttacaagaaacaagggaattgataatgtcaaaggacactttctgcaacctagtaaagttcgataataaaaatagtgattaaaaggaaccaaatacctaaattgttgaatgtgtttatttttagtcagacattgttcttagcacttacaaaattgatgctccctttaccaataatgaatactcttatttttcatattaactgaacacctaccatgtgtctacccccattaattcactggagatatcagtgaccaaagaagactgataggttctactgttattcctatttacaaaataaaaaatagaagtataaggaactatcaaattatgaagccattgtttgaacccaaaatctgactgagccctcagttcttacatgctcccaggaatatttctggtcataagaactagagcgatttctagattgatcaatattttcccagtagagtcctgcctaggtaatgacagagtctttctcttcagctgtttactagtcttcttcactgaaattccccatttgatcatgccaacatgttacattacaattaaattgggtcccattttgcttacacattatattctagttttgtttccttgagattatattttatatgcttgaatgtatttgtcaaacacttggttcattgcagtaaatatattcataagcaattgtttgaaaccctacatatttctactcagttattcaaatatccatagtgctttagatttctacctgtttagtgcaatcctaattaagactaagtcatgatcaggatattgaaatgagctaaattagaactaaaccaaggtaaggtgcagagttcagggaaggctcatctggaagggctctctaaggagattaaaggtgtggaaatagaaacacttctggggaaatggggaagtccagtgcattagaggaggaggactgagatgacaaaagattctgaatcacctgacttttcagctggttgatgccttttatgttgtaggtcagctgagtttgctgctgtgttgattgcgctgacttactttgaggaactggtaaacaaaaacattatgctgacacttggtattacggtaaggaagacttaatttaggactcttgcaacagatgccaaaactatcacaataggggagagagatcaatctgaactcaattctgaatataacaaagacagccttggatttgtagccaacaagcagaatgagaaagtctatggatagaaaatcactaagaaaatccttgctaaatcaacttaacagaatttttgccaaagtaaagccagggcagtcagatatctagggtacaggaattctcataaaactgacttaggaagattcttgctacatctggaccaggcagaactaagagtggactccaagacatggtctattcaaaaagagagctcagaggagcctgactaacatttggtgaagaagagagcctttcagaaccctaaagggataaagagtaagagacagaactatcttctaaacacttaaaatggcatatgaaattttacatcttttatggaaaaatgggaatttaatgatgatttcaattaatgaaatacactagtaaaaatttaaatcatctgtataagaattttggactttttaacttttattttgaaacaattttagatatgcagagttgtaaatgtagtacagagagtcctctattcccttcactcacttctcctaaggttaacagcttacatagccatggcacaactatcaaaactaagaaatcaagattggtgtactaaccctaattaaacttcagacttcactcagatttcctcaattttttattgatgtctttttcctattcaaggaatctctccaggatcccatattgcatttcattgtcatttctctttattcttctctaatctgccatacacgctcagtctttcctgactttcatgaccttgaaactttttaaagaatattagtcaattatttttgtagaatgcccatcaatttggatgtgagtgcattttctcattattatattaaaattatagatgtaaaagatgaatacaatagagtgaatcttgtcacatcaagtgatataggagatatatatcaatatgttgccttattactgctgatattaaacttattcacttggtaaagtttggatatgcctgttttctccaatacaaagttgctatttttcctttccatactctttatattggtaacacgtcactaatgtgagcttacactcaaaaggagggaaattaagctccaccccatggaaagagaagtatcaaagactttgttgacatgtgttaaagcttcacagtaatttaaaaatcttttggagggagatacattgaggatatgcagttatcctcattctcttcaaggctttgcttattgattttatgattcaacagtagatcttgcctgttgcaattatatttatgatgttctgactatgatattctattttcctcgttccttgtacatttattatttgaaatgcttttgaaagatggagttggcctcccttcccaataaatgtatttatttactcattacttatattagtataaactcatggatatttattccattctttatgtgataataaaatactatcattatctattgtgttactctagttgtcccagctttggctattggaagctcattaaggctggcttctgtgtccttttgacatgtacctatacattttgtttttgcatacttcttcatcttctggcaccacaagatactccagtatccttgtatttccatgacacagaccaagaatcagtcatttctccaagatgtattaatgccttttattggagattggtattttagaagacaagatctgagagctacatgtgcttagcagtactaggatgtcactgcttttaggtcctctcagtgacagagataggaatataagtagtacatatacgtatactaattttttatatacacatacctatatttatttctgtccacacctatatctaagtaaagactaaagcaaacatgagactatacaaatatctttgattctaatccagcacaataaggttaattctagcctttccattttcattatttgaaacttctttttccaactctgagatacttggtttttgttagtaacaatatttttacctatttactcaagtctaataatacacataatgtttcggaactactaactagaatttctgtgagaaacaattctaccaactagcatacagtgtttgtgtacaacccttttgtgtttcaccttaaagtatctagtcaccacatggctagacagagtatttgtcactttcagagtggttatgtcatacatcaattacattaatttgtcatcatctagattcaatcctggtatctactgccaatgtggttgagtttttaaaaatttacatacagtaaaattcacaccttttggtgcatagttccacaggttttaacaaatggacagaattatagttcatttatttttacctcaagttttcctgtaactttaaaggtgaacaaaaagtttttgccattgtataccgtgaaaattgccttggtatacagaatctgttgttttaaatgacaggatctcattctttttatggctttatagtactccattgtgtatacgtaccactctttgcgtatttgagataacagccatttatcagatatgtccttgaaaacatatttctcccaatatgtagcttttcatattctcttgacagcatcttttgaaaagcataagtttttaattttaatgaaatccagtttacaaatttattctctaatagatcatggatcatgtctttgttgttctatctaaagtcattgccaaacacaaggtcatctaaattttggcttttcttaacatatttatgataaagacaactgggtcttatattttactgacaacaacttaggcacattcattgtatttttttcttttctttctttctttctttctttttttttttttttttttttttgagacagagtctcgctctgtcacccaggctggagtgcagtggtgtgatcttggctcactgccacctccacctgccaggttcaagcgattctcctgcctcagcctcccgagcagctgggactacaggtgtgcatccgcatacccggctattttatttatttatttatttatttttgtagttttagtggagacaggatttcactatgttgatcagggtggtctcaaactcctgacctcaaatgatctgcccaccttggcctcccaaagttctgagattacaggggtaagccaccatgcccagcctcattgtattccttttcttttagatagagactggttccttgaagtacctcttcatagccatcaggaagtattcacttagctcagagatttcttctactgttttctcctgatttcaataggtcttcaagtctttctgctggtgctgatatgcagggaggaatttccaccaagtgtctcattcaaagcagcaacggcatcctctgcactgaagagattaaagatttgctacagcacctcaaggagtaaagcagtggcctcagccttctgtaactggctccatccagttcctttgtactgcccccaggaagtacaaagtcatatctgttcattagacaggaggaaagaaagtctcctcattgtctctgaagcataaatattcccctgctgatcaaaccttggctctttggtggttcacagccatgaatgctgcagggaggcctaagaacattgctagcaccattgttataaagatggaggaggccactgaaaatcttgtaggtgctactggcctggctacatgtgtagtgtgtgaatcttggtcctcaagctatctgaagatcttttaccatgtttcccttttaaatcaggaacacaatagttttcacttctggaaggcctgcacctgggacaagtgtccaggattgtagtagaggtggctctctcttccactcttttcttattggtataatgactctttcagttggtgccaatattcattgtgcaaatcctagttattttcaggtataatgggtgagggaatttaaattccaaaaccagcattattttcatcttttcatggcaccatctcacctcaaaagtaattgtcatgtctctaatgacaccctatgttctgaagtgacaaagtctagcttgatcaatacaatatgcacacagccatgtgtcctgacatccaactcttcccgactcaaccccctttggcagggcataggttacttctgtcagtaagatattcctgtattaggtggtttcaggtgtgctcaaaatattccctagctttcttaccattacctaagcacttcctcagtttactaagtgtgaatataactgagaaagtagtgagatgtaaccttatatcctcctgacactggtatcagatagtttgacagactacagatgactccatcaaacaaatattttctgcattcccatgctctcattaccagatatgcaatacaagtcacaatttatacctccacccatgtgcatttatcattaattctagaccaatatactcaattgtcaatgagatttctacacttacattgttttccagtcaccttagaaaggatgtctactattgtttttttttccaacatgattcatagctaaaatttttgttatatatacacatcattgtcctttagttctttttgcagtatttctttttttaatttcatttttaacctttattttaggtttgggtatacatgtgaacacatgtctacataggtaaacacgtgtcacgagggtttgttgtatacatcttttcatcgctcaggtattaagcccagtacccaatagttatcttttctgctcctctccttcctctcacccccgaccctcaagtatacccaagtgtctattgttttcttctttgtgttcgtaagttcttgtcatttagctcccacttataagtgagaacatgcagtatttggttttctgttcctgaattagttggctaaggataatagccgccagctccatccatgttcccgcaaaagacataatcttgttcttttttatggctgcatagtattccatggtgcatatgtaccacattttctttatccagtctgtcattgatggacatctaggttgattccatgtctttgctatcgtgaatagtgctgcaaggagcatttgcgtgcatgtgtctctatggtagaatgatttatattcctctaggtatatactcagtaatgggattcctcagttgaatgacagttctgcttttagctctttgagggattgccacactgctttcaacaacggctgaactaatttacattcccaccgacagtgaataattgttcccttttctccgcaacctcaccagcacttattttttgacatcttaataatagccattctgattggtgtgaaatagtattcattgtgttttaatttgaatttctctaatgaccagtgatattgagtttttttgtcattaaagtgaaagaagagaagtgattttccacctacacaatcaccaagtgtaagttcacaaaatataatgcagcaaaattgggaagtagggactctggcagcagggacgaatgaaggccaatgttgacacacacaaaggcaggaaaatggctccatctttagggtgctcaggatgctctttggcagaataatggatattagccttgcctgaatattctacctggttaacaaatccactcaggcaatgaaatgcttgcttttagacacctagaattaaaagacgggggattaggtaagccaaaaaatagctgctcttaatgtaacactgagttttattgcatgcttaatatggaccatccagtgttctaaagtctgggacactaaggtcccagcactaggcacggtgctgctcagccagcctgctggtgaatctgatataggtagcccaaggggctgttttgcagacccaagacctgggtgcagggcatccaagttagaaagaggaagtcaaattgtctctgtttgcagatgacataattttacttatagtaaaacctaaagatttgggtgcagggcgtccaggttggaaaggaagaagtcaagttgtctctgtttgcaggtgacataatcttatatctagaaaaacctaaagatgctaccaaaataacccttagaactgataaatgaattcagtaactttgcaagatacaaaattaacatacaaaaatcagtggtgtctctgcacatgaaaaactagctggaaaaaaaatcaagaaggcttcctgatttcagtagccataaaaaagtaataaaacgcccagtaatatgtctaaaccaggaagttaaagagctccagaagctaaatttcaaaacactaatgaaagaaatttaagaggatataaacaagtagaaagacatctcgtactcgcagcttggaagaattaatattgttaaaatgagactaccactgaaagcaaactacagattcaatgcaatgcaatccctaacaaaataccgatgacattttctatagaaatgaacaaattctaaaaattttatggaaccacaaaagaccactaatagacaaagaatcctgaggaaaaagacagtactattcagccataaaagagagtgagattcagtcatttgcagtaacatgaatggacatttatccaaaggaaagaaaatcgttatatataagagacatctgcatccccatgtttattgaagcattcttcctgatagccaagatgtgaaattaacctagtttgccaacaacagatgaatggataaacaaaatgtggtacatataaagaatgaaatactattcagccatgaaaagaatgaattcctgtcatttgtggcaacatgaatggaactgaggacattatgtttagagaaatgaggcaggagcagaacattaaatactgcatgttttaactcatatctggaagctcaaaaaaaagttgatttcatagaagtaaaaagtagaacacagaggctaccagaagcaaggaagtgacagtgagaaatttgttaaccaatttcccatttagaaaacagtgcagcttatgaccagcactcatttcttggggcaaatggtaaatgtgataaaggacgaaattacagctagataggaagttaaggtctagtgttttataccaggagtccccaacccccaggccatagactggtaccggtccatggcctgttaggaactgggccacagtgcagtgcagcaggagatgagccatgagcgagcaagcattactgcctgagctctgccttctgtcagatcagccatggcatcagattctcatggatcaaaccctattgtgaacagcgcatgccaggaatctagttgtgtgctccttatgagaatctaagtaatgcctgatgagctgaggtggaacagttttgttccaaaaccaccacgccccagtttgtggaagtgggaaaattgccttctgcaaacccagtctctggtgccaaaaaggtttggggaccactgttttataccactgtaggatctagtttacagtaacatattatatagctgtaaatagctagaaggaggacacttggaggactgttcccaacacaaagaaatgataaatgtttgagatgatggatatgctaattaccctgatctgatcactacgtgagtattaaaacatcactatgtttgccattaatagatacaattatctgtcaattattaaaaagaaaaatagaaattttaaaaaattaattcaatcattttcaacaaacctttatttgtattacactcattgtgtaaaatctggacggatgaactgttctaaacatgccagcaatccaaggtgaaacccttacggagggttgagatcactggcttgtgcaaaagggcctgttaaacagccaaggaatagatacgaacaagggcaacaaagatgttacaagtaaatttaactgactgactttagattctaagtagacaatttaaaaaaaaattataagggagtagatctgtcctcccaatggaaaaacaaagtctaaggattaatgcagagaaatatgttaaaataaatattaatctatcacttgtagacccttggaagcctatttatttttaacccttgagctattttgtgagtttaagaataaacaaaaagcacctaacaatttttggtctactgatagtaccaccatgtaaggtctgacttatctcctttaggacttcactaatttatcaggagaccttcttcaggccagcatgctgatctcattcccaaagatgacagcactgtttcttacctccagctcagactggaattaatcgtgtgtactgatagagtccagtaaagaatcctcttctgtatctttccatccaatagtcgagttttgagtgctgaagagacctttgatgactaaaatggaagaatattatgcagttcttgcacagaagtgaagggttttaaagagctgcttaccaaggaaagtctggctttaatgccagactcagcccagcttgcctactgtggttgattcactagatgaaggagataagcatttccctagttcacacagctcacagcaatcagaaaacataccatgctacctttttgaggttagtagccctttgttccccatatcattaatccttcatttttttggccttgtcaaggagagaccaaattcacagaatgtgtgtgtgaaatgtaaggagttgggacatcgtttttctacaactgagaaacctaagcttcaatcatttgatgatatttaggtgacactagtatagaaccagcatgagtatatcagggtacatatcagaaagaatcagtttttaataaaacaaataaattttattatccattttttggatgattcaaaagaaagaaataaaaggcattcattaacaaatctctcacctttgccctctctcctaccccatacagaaaacacactaagacaggtacaccatgggaaaaaatagtctttttaacaaacagtgttggaaaaactggttatggacatagaaaggaattaagttgaactcctacattacatacaaaaagtaattaaaattgaattaaacatctaaacataatacctgaaaacatgaaactcctagaagaaacctacaagaacagctttataacaatggatttaacaatggaattattggatatgataccaaaagcataggcaactaatgtaaaaatagataaaggaaactacatcaaaattaaaagcttctgtgtctcaaagatacaatcaaaagagttaaaagagcaatcttaaaaatggaagaaagtatttgcaaataatatatctaataaggagtaatggccagaatctataaggaacttctacaatcaacaacgtgatgagttaatgggttcagcacaccaacatggcacatgtatacatatgtaactaacctgcacgttgtgcacatgtaccctaaaacttaaagtataataaaaaaaaagcatttaacttaattttaaaagggaaaagatttgaatagacatttatttaaagaagacatacaaatgttcaactagtatatttctatggtctgaatgttcctcctaaattcttatgctgaaatcctaacactgaggtgatggtattagaaggtgggcattttggcaggagattaaaccatgaggacagatccctcattaatgggatcagcccccttataaaagggaccccagagagccaaatttccttccagcatgtgaggataccatgagaagacatcatcatttgagccaagaaatgggcccttagtggactcagaatctgcaggggccttgatgttggactttccagcttccagaactgtgagaaataaatttctcttatttgtaaattaccaggttgttggtacttgttatagcagctctaacagactaaggtacatatggaaagatgctcaacctcactaactgttagggaatacaaatcaaaatcacaatgagatagcacttcacatccatcagggggttactatataaatagatgatatagatgttgatattgtataggtatagatagaaataaattacaagagttggcaatgatatgaagaaactgaaacccttgtgccctgttgatgggaatgtgaaatcgtgcagcctggttgcaatgagaaacagcacaatgttcctcaaaaaattaaaaatagaattaccatataatccagcaattccacttctgagtatatgtcctaagaattttttaaataagcgtttgaagatatatttgtacataatgtttgtaaaagctttcatcagtatagccaaaggtggaagaaacccaagtgctcgtcaatggatggatgaatagataaataaaatgtggtatacgcatataatggaatattattcagccttatatgcattctattaaacatagtacagaatattattcaaccttatacaatgtaatattatactgcattatattattcagcaaaatatgatatatatgtataataaaatattattcacctgtattctgacacatactacaacatgaatgaactttgaggacattatgctaagtgaataaaccagtcacaaaataacaaatattatattattccacttgtatgaggtatctagagaaatcaaattaatagaaacagaaagtagaatagtggttgccaggtgctgaggtgtggagggagccagaaggaatgtggaggtgctgttaaaagagcatagaatttcagttttgcaggttggaaaagtatggagattagttccacaatggcgggaatacatttaacactattgaactgtatacctaaaaatggttaatatggtaaatattatgttaactgtattttattttaattttaaaaatatgtaacaaaacaacattattccactgggaaaaaaatgacaaatataacttggctaaattctgcctaaccaagaggtgattatgagatgaggtagagaggaattgaaattggacaaggatgtaggtcaaaagcagtagatgggcatatgcccaaggaaaagtcatcattcctggtctaggggctggccttcagatttgggaaatccagccttcacatagttgaggacatatcaaccaagtcaacagagtttacacacaaatggtaaatttttgagagtacagtattctctctggataacgggtgttaattgcactaagttctttcttagtggattaataaactcagaacagtaatcattttcttgtcatcactgtcacaagaagcaaggaaatgaataatttcaaaggatgcttccctcaactcaatagttaaataatgaggagagtgtcaataagaagaataaaatcgctaaattctagaaggtgtttattgtaagccatgcattgttgtaacacttacaaatcagtcctcattttaccccatttcaaacacccacatttttcatatttattgaaaacttaccagtgctcagttccatttaatcactgtagatatcattgtgtctgatggttaattttaggtgtcaacatgactgcattaggaatacctagcaacctggtcaagcattattttggggtgtatcccaaggtgtttccaggggagattatcagtgctctaggtgggtaagatccgacctccatgtaagcaggcaccatgcaatctgctctacagtccaaagaaaacaaaaactctatctgtgggtctatctgctggaactgggatgaactctttctcccctgtccttggacaacaactccaagctcccctacctgtgtactctagggcttaaaccagaagccaccaggttctcaggactttggtctgggactgagagttacattatcagcttctctggttctgtggggagcttcagactttgagtgagccacactaccagcatcccagggtctccagcttacagatggcatgtggcatgggaggggcttttcagacttcataactgcatgagctaatccctctaatgatgtatttgaaggattagctcgtgcagttacgaagtctgaaaagctttttaacttaaaaagatttgagggatcacaataaatgataaaatgtaattccactgattttgtctcactggaaaacacctgagtaatggaaaacacctgagtcatacagtgaccaaagcagacagtgaagtttctattattatatccatttatagaaaaaaaagacagaagtgcagggagctattgaattgtggagccactgtctgaatccagaaaatctgactgaatcgtcaggtcttacatgctccctgggaatattttggccataaaaaccagatgtgatttctagactgatcagtgcttttccagtagagtcttgcctaagtaatgacaggctctttctcttcagccattattctttttcttcactgtaaagtctcatttgcttatgccagtcatgttacatcatgaataaattgggtcctattttacttacacttgttatatcctactttttgttttcctaagtatttacttcataggtctgaatgcatttgaaaaatattttgttcatcccagtaatatacacaacatacataattgtggcacagttatcaaaactgagaaatttatagtggtacagtattactaactaagcttcagatttcaacaatcttttactaatattatttttctgtttcaagaatcaatccaggatcccacattgcacttagttgtcttatctctttagtctcctttaatctgtaacacgtgcccagtctttcctagtctttcatgatcttgagacttttaattaaaattggtcaattattttgtagaatgtccactgatttgaatttgtatggtattttctcatgactagattgaagttatagatttaagggaagaatacaatgtcattgccaagatgttgacctgcctgcctatgtgcacaaatatgtatgactcacacagacacagagtcacatggagccttttccacaggtcccagactgcacattgagtcagtgtgtgaaaccaccctaatgctctggcaggactcccggtccaggtgtcttggtggctatctaaaaagttggtgtggtgtcctagcatcatcagtgcaacatgtagcttgcttcacatggaatcacagtaatttgagctcattataaccctttgaacaggcttagctggaatttccatttatatgaggttttatttgaatgtgtctttgatctttaaaggtttcataatcaccagcttcatgattaactgtgacaagctgttatatgacagacctttagatactcacattaatgactaatgattcaaatttgttatttatctaggtttaatgttcttgtttcatggatcctaatcctcaggaagtgttcaaattctaaatgagcctactcagtgcagagtacaccaactggaaagagaagaaacggaactaaactgccattgtcttcttcttctgaattaactaagttaaattaataaattttgtaaaagtctttgctgtattaggaattgtgatcttgcaatgcgcattgctctgcagataaatctcctgccagaagacagacttctgcataaacagaaaagcctggtctccacagacttggttgcggtcttggtgcattttcgtcatcagtggctctcttcacctaaaaatgttttaatagcctcagagtaaaatggaacagccttttattttctttttgctaagctaatgttacatcattataacagggacattccctcttatccagaaatatttataagaaaagaaaaacagcctttcatataagagtttctgaaaaacctagaactttcattcaacgtctgctttaatttgtggttttgtactcttaaggggaaattggtggacaaaacccacaagagaactgagaacagctgtatgaagaggcaatgcaggttaatgaagagtgaagagaagagaacagtgcggatttctagaagaagaggaaggaaattattgtgatatgggagttaaaaatgggatccagaaaaacagggaggaaagggggaagtgtgccaggtctcagaaccagcaaaggttgctatgtatatttcacttcagtttaggagactaactttatatggaagtatattctggaattctgagagccagaaagggaatgtgccaggtgccagaatcagctaataaacatcatatatcttctgcacttcaatctagatggtgcttcttctctctcaggtatttatacaagccaccatttcctgactgaatacaaatagcaaacttctttgaaataaggagggataatttttcaacccctccagattttttgacagaattctaggtttttagtttgcctcctttggagatgggtttctgaaagggaggacgtagttcctaagaatgttatagaaagacgaataatattctcttctctagctggatgaaggaaaatagaaaaatacctgccatattttaaatccttactctgtgaaggataccacacacagtgctttaaactatatgtgttcatttaggaataacaactatataaatatttgaacccattatatttataaaaaaactgagctcctgcagcctctgcactgtgctgccaccactgccactgtgaatgcctacatggagtccaacacccctgcactcaccagtgccccactgcagtcaatgagcatttgccttcccaagctgctgacacatgcaaatgaggaaggatcccactgccaccactctatgaatcactgtggctggcaccacctatcagagtgttctgaccagtggttcaggagcaaattaggccccttcagcatggcaggttgcgaatctccaggggccccagaatgaagcttcaggcctgatagtagacacccacagtaggatcatgcagttcagggctcctaagctgagccttggcccacttaaatccccatagattaagccaattgactgaacccacattatagcaaaactaaaccccaaagaatgttacataggataaaagaaataaaagcaatccaaaggttagcaacttcaaagattgaaggaccatcagcccacaaagatgagaaagaaccagttcaagaactctggcaactcagaaaaccagagtgacttcttacctacaaacatccacactagttctacagcaatggttcctaaccaggctaagatggctgaattgacagaaatagaattcagaatatggataggaatgaagatcatcgacatataggggaaagttgaaacccaatccaatccaaggagtctaaggattacaataaaacgatacaggagctaatagatgaaatggtcactataagaaagaatcaaactgattgatagagctgaaaaatactgtacaggaatttcataatgcaattgcaagtattaacagcagaattgaccaagctgaggaaagactctcagagcttgaaaactggctcttccaaataactcagtcagagacaaataaagaaaaaacaataagaataaacaaaacttccaaggaatataagattatgtaaagagacccaatctatgacttattggcatgcctgagagacagagagagaaaccaagcaacttggagaacatatttcttttttttttctaaaggatgtatttttactatgatctattattcttaattattttcacaaaattgctggtaatccttaaaaagttgtattttgttgctgattaatgccgtcaactgaactatctctgtaaagcataatgatattttattttattatatttatatattttttattttattattattatactttaagttttagggtacatgtgcacaacgtgcaggtttgttacatatgtatacatgtgccatgcttgtgtgctgcacccattaactcgtcatttagcattaggtatatctcctaatgctatccctccccccttcccccaccccacaacagtccccagtgtgtaatgttccccttcttgtgtccatgtgttctcattgttcaattcccacctatgagtgagaacatgcggtgtttggttttttgtccttgctatagtttgctgagaatgatggtttccagtttcatccatgtccctacaaaggacatgaactcatcattttttatggctgcatagtattccatggtgtatatgtgccacattttcttaatccagtctatcgttgttggacatttaggttggttcccagtctttgctattgtgaatagtgccgctataaacatacatgtgcatgtgtctttatagcagcatgatttataaacctttgggtatacacccagtaatgggatggccaggtcaaatagcatttctagttctagatccctgaggaatagccacagtttcttccacaatggttgaactagtttacagtcccaccaacagtgtaaaagtgttcctatttctccacatcctctccagcacctgtttattcctgactttttaatgatcgccattctaacaagtgtgagatggtatctcattgtggttttgatttgcatttctctgatggccagtgatgatgagcattttttcacgtgttttttggctgcataaatgtcttcttttgagaagtgtctgttcatatccttcgcccactttttgatggggttgtttgattttctcttgtaaatttgtttgagttcattgtagattctggatattagccctttgtcaaatgagtaggttgcgaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggactaacatttaagtctttaatccatcttgaattaatttttgtataaggtataaggaagggatccagtttcagctttctacatatggctagccagttttcccagcaccatttatgaaatagggaatcctttccccattgcttgtttttctcaggtttgtcaaagatcagatagttgtagatatgcggcattatttctgagggctctgttctgttccattggtctatgtctctgttttggtaccagtaccatgctgttttggttactgtaggcttgtagtatagtttgaagtcaggtagcgtgatgcctccagctttgttcttttggcttaggattgacttggcggtgcgggctcttttttggttccatatgaactttaaagtagttttttccaattctgtgaagaaagtcattggtagcttgatggggatggcattgaatctataaattaccttgggcagtatggccattttcacgatattgattcttcttaaccatgagcatggaatgttcttccatttgtttgtatcctcttttatttcattgagcagtggtttgtagttctccttgaagaggtccttcatatcccttgtaagttggattcctaggtattttattctctttgaagcaattgtgaatggcagttcactcatgacttggctctctgtttgtctgttattggtgtataagaatgcttgtgatttttgtacattgagtttgtatcctgagactttgctgaagttgcttatcagcttaaggagatttttggctgagacaatggggttttctagatatacaatcatgtcatctgcaaacagggacaatttgacttcctcttttcctaattgaataccctttatttccttctcctgcctgattgccctggccagaacttccaacactatgttgaataggagtagtgagagagggcagccctgtcttgcaccagttttcaaagggaatgcttccagtttttgcccattcagtatgatattggctgtgggtttgtcatagatagctcttattattttgagatacgtcccatcaatacctaatttattgagagtttttagcatgaagcattgttgaatttggtcaaaggccttttctgcatctattgagataatcatgtggtttttgtctttggttctgtttatatgctggattacatttattgatttgcgtgtgttgaatcagccttgcatcccagggatgaagcccgcttgatcatggtggataatctttttgatgtgctgctggattccgttggccagtattttattgaggatttttgcatcgatgttcatcaaggatattggtctaaaattctcttttttggttgtgtctctgccagactttggtatcaggatgatgctggcctcataaaatgagttagggaggattccctctttttctattgattggaatagtttcagaaggaatggtaccagctcctcttggtacctctggtagaattcggctgtgaatccatctggtcctggactttttttggttgttaagctattgattattgcctcaatttcagatcctgttattggtctattcagagattcaacttcttcctggtttagtcttgggaggatgtatatgtcgaggaatttatccatttcttgtagattttctagtttatttgcatagaggtgtttatagtattctctgatggtagtttatatttctgtgggatcgatggtgatatcccctttattatcattttttttgcgtctatttgattcttctctcttttcttctttattagtcttgctagcagtctatcaattttgttgatcttttcaaaaaaccagctcctggattcatcaattttttgaaggattttttgtgtctctatttccttcagttctgctctgatcttagttatttcttgccttctgctagcttttgaatgtgtttgctcttgcttttctagttcttttaattgtgatgttagggtgtcaattttagatctttcctgctttctcttgtgggcatttagtgctataaatttccctctacacactgctttgaatgtgtcccagagattctggtatgttgtgtctttgttcttgttggtttcaaagaacatcgttatttctgccttcatttcattatttacccagtagtcattcaggagcagcttgttcagtttccatgtagttgagcggttttgagtgagtttcttaatcctgagttctagtttgattcatatttcaaaatgttgtccatgaaaattttcccaacctcactagtgaggccaagattcaaattcaggaaatgcagagaatccctgcgaaatgctacagaaaaagactttccctagcacacgtagtcatcagattctccaaggtctaaatgaaagaaaaaatgctaaaggcacctagagagaaggggcacatcacctacaaagggaactgtgtcaggctaaaagcagacctgtcagcagaaactgtataaaccagaagagattaggaacaatattcagttgtcttaaagaaaacaatttttaaccaagaattttatatctggccaaactgcactttataagcaaaggagaaataagatcctttacagacaggcaaatgttaagggaatttaccactaaatctgacttacgagagtttctctagggagtgctaaatatggaaaggaagtacacagaccaatgacactataaagaaatcacatgaaggagtctgaataataactatataacaacattatgacaggatcaaatccacacttaccaatactagccttgaatgcaaacaagctaaatgccgtaaaattaaaaggcagagagtgtcaagttagataaggaaccaaaacccaacaatatgctatcttcaaaagacccatcttacatgcaatgacactcacaggctcaacgtaaaggggtggaaaaaaaatcaacgaagcaaatggaaaatagaaaaatgcaggtgttgctattctaatttcagagaaaacacacttaaaattaacaaagatcaaaaaagacaaggaagggcattacataatgataaagggctcaattcaacaagaagacctaattatcttaaatatatataccaaaccctcagagactattacaaacacttccatgcacacaaactagaaaacctaaaagaaatggataaatttctggaaacataaaccctcccaagactgaaccaggaagagactgaatctctgaagagatcaaaaatgagttctaaagttgaattggtaatacaaagcctacaaatcagaaaaaggcaagaccagatgaattcacagatacattctaccagatgtacaaaaaagacctggtaatatttctactgaaacgattccaacaaattgaggaggaagcactccttcctaacttattctatgtggtcaccatcatcctgacaccaaaactggccagagatacaacaagaaaaggaaaacttcaggtcaatatccttgatgaacactgatgtaaaaatccttaaaaaagatactagcaaatgaaatacagcacatcaaaaagctaacccaccacaattaaataggctttatctctgggatgcaaggttgtttcaaaatacacaaatcaataaatgtgattcatcaaataaacagaactaaagagaaaaatatattattatctcaatagatgcagaaaaggcttttgataaaattcaacacctcttcacattaaaaattctcaataaactaagtattgaaagaatatacctcaatataataagagccatctatgacaaacccacaatcaacatcatattgaataggcaaacctggaagctttccccttgaaaactggcacaagacaagaatgtcctctctcaccagtactattcaacatagtactggaagtcctggctggagtaatcaggcaagagaaagaaataaaggacatccaaataggaagagaagtcaaattatccttgttcacagatggtataattctctatatagaaaaccccatattctctgcccaaaagctcctcgagctgatacacaacttcagcaaagtttcaggatacaaaatcaatgcacaaaaattactagcattcccatacaccaacaacagtcaagctgagagccaaatcctaaatgcagtacatatataccatggaatactatgcagtcaaaaaagaacaagatcttgtcttctatgggaacttggatggaggtggaggccattatcctaagcaaactaattcaggaacagaaaatcaaatactggatgttctcacttataagtgggagccaaatattaagtatatatggacacaaaaaaaggagcaacagacacaggggcctacttgaaggtggagggtgggatgagaatgagaattgataaactacctattgtgtactatgcttataacctaggtgatgaaataattcatactccaaatgtctgtgacatgtaatttatctatatagcaaacctacacatctacccctgaacctaaaataaaagtttaaaagaaaataacagtgatatgtattgcttttttaatgtagaaagtatattttcaaaagaaaactgaggctcagagagattaagtggttttctgaacatcacgcttacatgtaagcagaatgtaatttcaatgtaaaattctttatttttatttacacctgaggtataagctttgtattcaggatttctgtaataattattacatctcctcttactactgagttatatgcaactctctgccgcactctgaatttctctttggttcacgtattttcagctggttttggccaaaagtataaagagattctctcatccagtttcccattttatttcatgagggaagtttgtcattttttcctgacatgtaacatagtattaatcaaaataataataaattattatgcaaataatattatgatttaaatacataaaatattaaacatattaacatgacttgccaatagattgaatccacgaactctattttcaaaaaagaaaaactatgtagataaaaaatagtacacattctttttcaagtccaaccttatttcccccctccatttccatggcaaacatgtcacaattatttcctacatatggttatcactgatttctcttctctgattcactcttccacctactccagtatggtttgtactgattaattctgccaatccagctctcaccaagatctccaccgccatctatttttctgatgttctgggcagttttaatccacatttcccataagtctattgattcttcttctaagtacatttattttctaaatacatttttatcatcattccctcttgtccttctaatgtttaaggtattccacctctgtttcctttgtgtctctcctcttccctctctttaatggtggaaggtcctcagaatctagtttaagtcttattttcttctctacattggctcctcacatgacagcctccatttttaggcatttggttgccagttatgatcctccagacattgtattccttggatattgcaaactcatgtatctgactagcaatgcacattcgcaattacatgtttaaaagtcagtttagagaggctagctctgcttttatttttctttctggacgtgcctctatctgcgttctgctgagagcaattcactgttttttttcctagctcacattatagcatttaacataactcatattaatcataattattgttgttaaatttctggcaaaaatcaaagatacaagggaacaggaattgtatttattatgttcacttaagaaaaatcttcctttacttaaaatttgaataaaataatgataggtaactgaactgtaccatctgtttttaatcaagttatacaatcaggcttggagtttcattttaaagaataaacaaacaattaatagtaaaaatctaatgaacaaagcaaaataatcagttgacaaaacataaagaacatattttattatattagccacaaagtaaaggtggatgtaatattacctgaacaaacataatttaaaataatttaaatcttataaataaataaatatttaaatagattagatagaagacagacagatagataaatagatagaatagatagattggcatgatcatctgtaaagattttgtccctgtggagctaaagaagtgttgcttaacacgtgtgaaacgtttgaaaattttgattcaactcaagtcatggatatagcagaaattaatatttgaaacggcagaactcaagaagtgtgaaatggtgtactagtcaatgagaatcatttcgatgttgaaccagttttcattccttcctccttaatctttcttgcaagtttgctgataaagagaaggatctcatgatttctgctctgacaacctcccatgcacaagggctgtatttcttctctgtcagatagagggtgattctttgaaagtattttctcacagtcaggatagagtccacattcatcagaggagtgtcttccactccaacctcctgcatcatacaggcttccaggtcattcagctgctggtaaagttcagtgtagaatttgtctagaagtgtctcatcccaagtagcagatgagtcctttgtgctgaagagattgaaggtctgctggatcatctcatggaggacagagatggcttgagccttctggaactggttgccatcaaactcctcctgaggaaatccaaagtcatgtctgtccttcaggcaggagaaaggagagattcttcccatttgtgccattatcatcaaagtcctcctgttactcaggctgtgggtctgaggcagatcacagcccagagaacagattgacttgcagttgagcaccaccagggccatcagtaaaacaaagggcaaggccattggggaggttgcagatgcttctgggctgttgagattgagtgaccctgaaccttgggctcttctctgaagaccttgttttgtgcacagatcttaaaaaggtcacatacgagtttccattttctgaatgccttgtgttactttctacttctctttttgctttcttttatgctctttctacatagatgtacaggagtgtttctcagtttatttatttttacattattacctcatcttcctctgccacatatgctttttagaaattttttttctaactaaaaatcccattaaattttaataacacagatatactatgtgttggctgatgtatatacattacagtacccattatcgagagagaatattgtacttctttaatgctttaaaagcagcgtaatagaatgtaaaatagaatttattcagtcccggattaagaatgagcaaatgaaaattctaaggtaaaagttaataattaaatttacaatttatggatatttaacttcatagttcaatttgtttaagtaacaatgtgatttatttacttatataaattgtagtgtgtcagattaaataagtaaattaacaaattatgaaaatatataatattgcctagtataatgaaatatttaaaaattcaaaatagctaaagactattaaaattgaaattatttgtaacatttatttttagggtactttcaattttgcttcatagggaaatttaaaaaattcactagcttctagatattgatctagatattgtcaaaaacctttttctcttcagtgcttgacataattattgatgtgttgaacaactttagtagaattaaatagtaaaagataaagtatttttattgaaacctcaaaactcaaaacacagtcataaatgctcaggatcaaatataagcaacatacacaagacagcaaatgacagctcatatgtatacagaggccacctcacatgatatgactttgacatctaataaatcttggaaagtcctccaataacagccacccatttgccatatgcttgtagcactgatcttgtataccttttgtgtatcttccatgaactcaaggtcaatgcttctgatgttacaagaaaaccaaattaggccaggcgcggtggctcacatctgtaatcccagcactttgggaggctgaggtgggtggattacaaggtcaggagatcaagaccctcctggacaacatggtgaaagcccgtctctactaaaaatacaaaaattagctgggcgtggtggcacgtgcctgtaatcccagctactcgggaggctgaggcaggagaattgcttgaaccagggagtcggaggttgcagtgagccgagaccaccccactgcactccagcctggcaacagagcgagactccgcctcaaaaagcaagcaaacaaacaaacaacaacaacaagaactcaattaaaaaaatactaaggaataaagttttgtcagacagagttgaactttagagggccccaagaaataacttttacattcttggaagcaatattatacttaatgagtatatgcaatggagaaaaatgtcatcaatttgattttaaaaatattatttgtcatgaaaggtcagatttccaaagaacccacagaggttccaattctagttgattctcctcaaactgaagaaaaccatttttgtcctaaatgtccatagtgtaatgtaaatgtgatagcatgaatgggttgtacaattgtttacatagcatgcaggataccagagatctttctttctcattttcattttcattgaaagtaaaggttgtctctttttgaatccttaagaatggagacaaaaagaaaaatgtatatctaaatgtgattttaaaaatcctacagaatggagatagaaagaaaacaaatgtgtatctaaatgtgataaaagaatcctgattcttttctggtcacttgggctaggagattctaatcctaagttaatttgttagttttattttccccagcaccatctcactcacaaggcagttatcacagtcagtaacacccttttctctagagtgacaatatcctctagagagacaatatctcactgggaaaaaaaggatgacaaaatgcaactttcctacattcatcccagtaaagaaggagataaaggaatggggaagaggagaagcaaaatcgtagaagatatgtagatcaaagggaacaaatgggtatgagctgaaaaaaaagagtaatcattcctggtccacgcagtgttttcagctttgctgaatccagccttcatggagtcacaccaatcgcaagaatttgtacataaaaaaagggcaatttttaaaagagtaccatgtactctttgcataatgagtaagtgttaattctcaagttctcccttagtgtataaatacattcaagagatcaatatttcccttattatgttttttacaggaatcaagggagttaacaattttaaaggacacttcccccaatttaataaagtttaataatgaagataatgtttaaaaaaggaaggagacaggtaaattgatgaaggtgtttattttcagtcagatattgttcttagaacttacagatttgattctcattttaccaataatgaatatcctctttttgtattaactgaacccctaccatatacctacccaccatttattcactggagatatcagtgaccaaagaagactgataggttctactattattcctatttacaaaagaaaaaacagaagaacagtgaggtattgaatttgaggctactatttaaaccccaaaattggactctaaatcctcagctcttacatggtctttgggaatatttctggtcataagaactgatttctgcattggtcagtgttttcccaggagagtcctgcctaagtaatgacagggtctttctcttcagctgttcttttttactgaaacgtcccatttgcttttgccaacatgttacattacaattaaattagaccccattttacttacacactatattctagttttttcttcttgagaatgtatttccataagcttgaatgtatttgtaaaatacttggttcatcataagcaactctttgaaaccctatgtatatctactcatttattcaaatatccataatactttagatttctaccagtttagtgcaaacctaagtaagactaagccatgatcgggatataaatatgatctaaatcagaaataaaccaataagctaaggctcagagatcaggaaaaaaaccctctggaagggctgcctaataggattggaggtgtgcaaatgggaagcacttctggagaaatgtagagagtccagggcattagaggaggaggactgcaatgacaaaaggttctgagttacctgactttccagctggctgatgccttttatgttgtaggtcagcagagtttgctactgtgatgattgtgctggcttacattgagaaactggtagagaaaaaattatgctaacacttggtattacagtaatgaagactttatttaggactattgcgacagatgtcaaaactatcacaataggggagagagatcaatctgggctcaactctgaatatgacacagacagcctgggatttgtaaccaacaagcagaatgacaggatctgtggatggaaaatcaataagaaatatggccattgggagggccattgggaaatgagggttctgcaggcctggctgagctggggtctggttgaactttggaacctaggttctctgaagacattatttctatgcatggctttcaataggggacatctagtttttattttctgaacatttctctatatgtctactttttgttttcatttacatattgcatattaggcttaaaaacacaacatcaattgagacccttaatttttgcaatagaatttgcacagtaaacttcaggtgtgccaatctaaatgtacatttatcaattaaatgagaacagtcattgtcataaaggctgaagtgtatgtaggaatgtaaatacttatatacttttttcatacaaatattcttcttttctgtgtcaggtgaaaagttttcagccctgatcctaggttgcattataccctgcatgcattacataggctctctctaccatctgggtatctgtatttgagaatttatccgaccagctttgacaataaaccctttagaagaaagaattgggttttgtccattgtttcattcatagcagatgctgacgattattagttagtgagcctctctgatttttctatttatttaaaaatacattcatgcaattccatgtgattgtgcctcactggagccgcaggtcaggattaacgtagaaacagccctttcttcccatcattttcttactcaatgtctatagtgctcctcaggctgtgataatacccccatcaagaatcccgattcttctctggtcatttgggctgcgagattctaatcctaagttaatttgttaattttctttccccccagcaccacctcactcacaaggcagttatcacagtcagtaacaccctttcctctagagtgacaatatcctcaacccaaactcttccagattcattctctgaggcacaaagttagaactcctttactagggaaaggtctttttctttgagccaaaataattaatgctccaagatctttgcccttgcccttagagtgtttgtgtgaaggatttggcttctcaatggtgatctcctcctgtccagggtctgtgtcctcagggatcaaatgtgtgcacagtgctcggatgttgatagcaagtttccttttatacaaataggtaaaggaagtattcaattgccataattttaactttagcaagcaagtaacttttattttgacaattagagcttttatcagtcaatcagtcaactctttcatttttcttctttttttttttttttagacggagtctcgctccgtcacctaggctggagtgcggtggcacgatctcggctcactgcaagctctgccttccagcttcacatcattctcctccctcagcctcccgagtagcctgcactacgcccggctaattttttgtatttttagtagagacagggtttcaccatgttagccaggatagcgtcaatctcctgacctcgtgatccacccgcctcagcctcccaaagtgctgggattacaggcgtgagccaccgcgcccgcacactttcatttttcaatactcaaaactattgaacacttgttaggtttgacctttctgagctggtcacaggggagtcaaggttgatgttgtctcttgttagcaactaatatgacagaaactagtgactttcaattgttcatccagtcagtgtttctttggggttctttgttcctgggtctctgccttgctctaacagtgtagggcagttagggccaggctattctgtcaagaagaaataggcttctttcttttacctgtatgtgtttttttagtttaattttttgtacttttttgcactagtgatttctgggcaagctttgtcttgccattaatgcattacattctcattcatgatgaagtaacaaaaattaagggaagtaaaagacaggcaaaggggccacaactttttttctatgatttccatgatttctgttgcgggaagtcaggaaccccgaacagagggattggctgaagccatggcagaagaacataaattgtgaagatttcatggacatttattagttccccaaattaatacttttataatttcttatgccggtctttactgcaatctctgaacatgaattgtgaagatttcatagacgcttatcacttccccaataaaaactcttgtgatttcctatgcctgtctttaatctcttaatccagtcagcttcgtaagctgaggatgaatgtcgcctcaggaccctgtgatgattgtgttaactgcacaaattgtttaaacaataagaaatatgggcaccttgaaaaaagaacaggataacagcaatgttcagggaacaagggagataaccttaaagtctggctgcctgtgggctgggtggaacagagccatatttctcttttttcaaaagcaaataggagaaatatcactgaattctttttctcatcaaggaacatccctgagaaagagaatgcattcccagggggaggcttctgaaatggccgctttgggaatgtctgtcttttacggttatagataagggatgcaataagccccagtctcccgtagcactcctaggcctattaggacgaggaaattcctgcctaataaattttggtcagaccggttgtctgctctcaaaccctgtctcctgataaaatgttatcaatgacaatgcatgcccaaaacttcattagcaattttaatttcaccccggtcctgtgatcttgccctgcctccatttgccttgtgatattctatcaccttgtgaagcatgtgatctctgtgacccataccctattcatacactccctccccttttgaaaatcactaatgaaaacttgctggttttgcggcttttggggcatcatggaacctgccaacatgtgatgtctccccgggacacccagctttaaaatttctctcttttgtactctttccctttatttctcagaccagccaacacttagggaaaatagaaaaggacccacatgaaatattgggggctgaatttcccccgataatttcagatttttttttttctcatttcaactttcctagaaagcaaaacttgattgtcatttgtggtttaaaaaaaaaagtgcaaatgtcatgaaaatgaaaggacagaagtgcctttctactgacacattgccaagtgtaagttagtcacacacaatgcagcaaaactgagagctagggcctctggcagaggggatgaatgaaggccaatgtggaggcacacaaaagcagggaaatgcctgcatctgccagaggctcagagaagagtgactgctgaatctataaactgccctcagctttgcaagaccagccatctgacttttctgtgagttaatccacatttttaatttttgcatagtattatagtacacatttttaatttttgattgatacacaatatttgtacatatttatgggatatatgtgctattttgaaacatgcataagtcgtaaatgatcaagtcaggatatttaggaaatccattgccttgagcatttatcatttctttgtgttgtgaacacttcagatcctctcttctagctatttggaaatatataatacattgttgttaactttaacaactgctatcaaacattagaacttattcctttaatctaattgtatgtccacatgtgactggctccgaggagaaaaatgaacagtgacaccaatcacctctcaagagacagacaatcagaccctagttagtatgacaccaaccctctctggtaggataaggtatataattagccttggctgagttctctacttagttaataaatccactcaggcaatgaaaagattgcttctgaaaacctagaatttaaaagagagtgttagatgaccccaaagattctgctcttaatctgggtagcaataataatcataacataaaaatatattattgagtttctttgaatgcttattatggactatccactattctaaggtctttaaaaatagtaactcaggcccagaatataggcagaaagctgctcagccagcctaaggatgaatttgacagaggcagctcaaggggtggtttttgagtcacaggacctgtgtgcagggcatccaggttagaaaggagggagtcaaattgtctctgtttgcagacgacattttcttatatatagaaaaacctaaagaatttactaaaaaactcttagaactgataaacaatttcagtaacatttcaagacacaaaattaacatacagaatcaatagtgtttctacacacaaaaaacaaactagctaaaaaataaatcaagaagttaccagattttcaatagctacacaaaaattaataaaatgcctaggaataaatttaaccaaggaggtaaaagacctctgcaaggaaagctagaaaacacaaataaaagaaattgaagaggatacaaacaaatagaaaaacattccatgctcataggttgaaataattaatattgttaaaatgtccatactgcccaaagcaatctaaagatttaatgcaatccctatcaaaatgccaataataatcttcatagaaaaaagatactaaaatttgtatggaatcatgaaagaccctgaatagctgaagcaatcctgagcaaaaagaactacactggcgatatcacactactggacctcaaaatatactacaaagctgtagtaatcaacacaccatggtactgacataaaaacagacacatagacaaatgcaacagaatagataacaggaaaattaatccacatatcaataacaactgatttttaattaaagtgccaagaatactcactgaggaaaggatagtatcttcaataaatggtgctgggaaaactgaatacccatatgcacaagaatgaaattagaccccctcctctcacactatacaaaaaaaaaaaactcaaaatggaagagagacataaatctaatacctgaaactttaaaattactaggagaaaacataggagaagtctgtgaaaagattttataagtcagaccacaatagtacaggcaacgaaagcaaaaataaacaaatcagattatatcaaaaaacaaaagaaacaatcaatagagtaacaacctacagaatggagaaaatgtttcaaaaccagtcatacaacagggggttaatatctagaatatacaaggaactcaaacatctcaaagcaaaataataataataataatctgattatgcaatgggcaaatgatctgaacagacatttctcaaaagaagacatagaaatgaccaacaaatatgtgaaaaactgatcaacatcactatcatcatggaaatgcaaattgaaatcacaatgaattatcatcccacctcagttagaatggctattttcaaaacaaaaaacaaaaaataacaaatgctggcatggatgtggagaaaatgaaactattacacaatattggttggaatgttaactagtacagccactatggagaacagtgtggaggttctttaaaaaactacaaatagaacatccgtatgttgcagcaatcccggtactaggcatttatccaaagaaaaggaaatcattatatctaagaggcatctgcacccttatgtttattgcaacattatttccaatagccaagacatggaatctattccccaacaacaaataaattgataaagaaaatgtggtatatttgcacaatggaatattatttagctataaaaaggaataaaatcctgtcatttgtggcaacatggatggaactggcggacattatgtttagagaaatgagccaggaacagaaaattaaatactgcatgttttcactcttacttggaagctaaagaaacgttgatctaatagaagtaaaagtagaacagaggatactgtagcctgggaggggtaggaggatgggatggacagggggagatttgttaaaggatacaaaattacagctatgtaagaggctaaggtctagtattttataccactgtagcagtaatatattatatattattagctagaaggaggacagtgactgttcccaacacaaagaaatgataaatgtttgaaatgatggatatgctaattactctgatctgatcactattatcagcattgaagcatcactatatagtccatgaatatatacaattattatttgtcaattaaaaatataaaaatgaaaaaattgaaactttaaaaaatcaatttgattctttcaataaacctatttgtattacactcattatataacactttggagaagaataacaatctggagggataaactattctgaacatgccaataatgaaacgtgaaaaccttatggggacttgagataattggcttgtgtgaaagggtctgttagacaagtgaagaatagatatgaacaaaggcaacaggtatgtgttacaagtcaatggaacttactgactaaattctaagtagaacattgtttaaaaagttaaaagggagtggatttttcctcccaactgaaaaacaaagtctaaagtttaatgaatgatttctgcaataaaatatggtaaaataactattaatctatcagttgtagacccttggaatcttatttatttttaactcttgagcttttttgtgagcttaagaatatacagaaagcacccagcaatttttattctactgatggtacaaccatatcaggcctgtcttatctccttcaggacctcactaattccacaagagaccttcttctgtccagcctgttgtttttattccaaatgatgacaacactgtttctcacctccagcccagaccgacattcatcttgtgtactgatagagtccagagaagaatctcttttctgtctttccatccaatagttgaattttgagcgctgaaaagaccttttatatgaccaagatgagagaatattatgcacttcctgcacagaagtgaaaggttttgaagagcttcttaccaaggagaatttggctttacctctacactcagcccagctgcctactgtggttgattttacttaatttctaaccccatacaattacaaatcataaaataaaactgtagcaatgaaataaatatatcactaaaatcagcattaattgataaaatgataaaagcattattattttgtcagaaatgaaggatgtacttttcttgttttttggaccctcatcctcagaaagtgtccaaattctaactttaactgtgccaactgagtgcagaatgcacccactggaaaaaaagctaaaggagaattgaccgaccaacgtcctctttccaaataactaagttaaataaataaactagtacattttggcaaagatcttcgctgtcattagaaactgtgatttttcaaaacaaacattaccttatatcagtcctgctgggatgtctctgacccagttactgttaattctactcaaataactgctgtatcctttttgtttaattgttgtttcatttgttttatctttaaatcaggctgcattatgacccgaattatgacatgcctcggattgcattggccctatgcctaactttccctgcactctgatgacttgctgggtcctagggaggaaacagaagtttgcaacggacactggagtaacccttgtcccttccaatactctcaggctgctgtggtatcagtgttatccatggtggggacactgacgttggccatgtctccatgggaacactctgtggtttcagcatccactttaatcttctctctgatcagaataatcttaagtagttgattcagtgctcccatttgtattgctccatctcctgaggacctgccgctcttccagtcaatgtgttaagtatctctctcttccttccaagttctaaagctgctgcttgccttttcttcttcatgtttcataatgtgggctctgcttttttcaacaaatgagagtcctgagcctagtgtagtctcttcctagaggaatcagaacatagaagcacctgaacaggggcacagatgaacttctgcattctttaccaacacgttgggtataatcacgtgggaaagattctctctattgactatgtttttgtgcctagcagtatttaacttcaagtacttaacctttgcagtactgaacttgccaggcagggagagtccaggcatgaccatattcattttggatccttgatctcacaaaacctagctgtctccaggtggcactgtgccacgacttcctgtatctcctccaagggattcagggcagaaacaaggttttatgtgtccttctccaggggcactgcacaggcagggaactgtgtgaggcaggttatgacaatgccccttgctgccagctcagccaccacttcacctcagttctccaatactttagaatatataaaaaattaacttctgaatatgatcagggtatagccacagagatttttcagggtaagatgataatatgcgtacaatttttgcccactgaaatgacaagcaacaaaaaggaaaatcacattaaagaaataagcagtatagaaaataaccaagaattaaaggagacttaatatttgaaagtcgttaaacaatcatacaaacagagaaaggaagagagagaaccaggtatattaaactttttaatattttcccctgctcctaaactgagtaccccacattcagtggtaaaagaaagagacaagagacatattgtgaaatataactgaatttcccagtttctctcctctcccatttcccagtttctctcctctcccatttgaaaagtgcaatctgaaggttgggtctgtaacctgagcaaagaataagaaattcctcctaaattgaagcctcttcctactatctaagtaattctcacacacactcctgattaacttcttcaattacactatttgcagatcactttaatacttcccaaattctacacaaatagataccttctcttgatatcatttggcaagaattgtatcctctgattcctttacaaatgtctttgctctcttttactactgagtaaaaagcacaagggatgcaagttgactcatcattgaaaataacagaaaatgttttaattataaagttgggacatgacctaaggagtgaatgtgtaaaattagcaacttactgttaagaaagagctaatgtaccttaaccaggagatttttcttgatttcccttgtagttctacacctacattggcaggttgtactgattcccagtctagcacaaaacatagagggagggacaagtcaagaggctggaggcaagggacacgttctgaccctttctctctccacatagctgcccattgttcaaagaacatgtgcttcctgaatctgggagtgttttctctctctgtgatacaaaagctaagaaaatgggcttcttccaatattagggttaattctttccgagaaagatggccttttacaaatgaacgaaaatctccttcaagggaacagaattctttttcttattttttatttttttatttttattttcttattatcatactttaagttttagggtacatgtgcacaacgtgcaggtttgttacatattctttacagaacagaaaagcctgccctccatagacttggtgcacgtctttgccagtaggtggctctcatcctctgtaaatatttcaacggcctccagagtaaaatggatcttgcattctatttcctttttccacagggatggttacattattgtaatggggatattccttcttttccaaaactattcaccaggagggaagtaaaaaaaaaaaaaaaaaaaaaaacaggccagtgatttggatgtttctgaaacacctagaactctcactcaacttttgctttcagctgatggctttgtactcttatgggaaaattgacagccagaaattacaatggaacaggaagcagctgtatgaatggcagtgcaggttaatggtgagtgaatgaggagagcaccctgggatttctacgctggggagggaggaaactaatgtcatacagaaatgaaagaatgggatcctccagtaagtaggggggaagggagagtgtggcagccatcagaatcagcaaagtattgtgatttttccatggctgaaaatcaaggtagtcccatttccaatccccctccctccagaaatatatatatgtatatatatgcttgtatatacttaaattttatgtaacataaaataagtttatatacttatattaatatacattacatttttagattatgtattttgtaattaatatgtgtaaatataattatgtatacttaagtatatacagctttaagtattatatacttttacaatctcatataatttaatatatgcttattatattatacttaacatattaaaatatattaaatttgtatattattaaatatataagtatacataatttaagcatatgtatttaaatatacataaagaatatataggcctggcgtggtggctcaggtctataatgccagtactttggaaggccaaggcaggaagattgcttgaggccaggatttaccagcctggtcaacagaaggagacaccatctctaccaaaaaataaaaaattagccaggtgtggtagtgcacacctatagtctcagctatttgggaggccaaggtgggaggatcacttgggcccaggagttcgaggatgtagtgaggtatgacagcagcactgcagtccagcctgaacaaaagagtgagacttttgtcaaaaaaaaaagaatatatatttatatatcttatatatgtttttgtacatttaaaaatccatatgtaaatataatgtgtaaaaatatgtatacatttatatattttaatatatatacttcaatatatactttatatagaataacatatatacgatatgttatatatacacatatacaatatagcatataacatatattgtatgttattaaatacattacaatatttacttatttatttgtatttaaatatgtatatataaatatgtaagtgtatattctgtatatatctataggtaactttatataatactatattcagttagtttcaaatcacctttttttttttagggttgagttagagagttgtaaaggctaggaaaatggtttacaaaatatgttttacttgggcctaaaaataatcatcaatggtgatttgaaactaactgaatctgagtaaagggattattttatttatttatactattcacagagcagccattttctatcgcaacttgctgagacactggttccctggaacaagcttcatgggggctgtacaatttttcctctgtgcaaggcactactctgacaatgggaacctgggctctgctccttcacagttttacagacagtcccctttcctagagtttcaatttgagggacatcaacgtgttagacctcaggaatgtcaggggagctgcaatcaaagcttctcttgtctggatttggttaaatgtggactatacaggattatgttatttattacattgaaattaaaggtaactatcatttaccatgttcagattctcagccagtaatttgcaaactttattttatttcatctttgcagtttcctatgtgacaactattaaaattgtctcaattttgcagaagaggaaaggaaaatctgatgttgtttaagctcccaggagccacagatgttgtcacaaagtggcagtttctactgcctcccaatttccctcttcattagctttcagttcttcctcttggctgcactgagcatgctagtgtttaattaatcacaatcatgtcttaaatgccattctttgaatccatggagggtagtcatcatcctgtattacttatctgttaatctaaattgccaagcctattgtctgtcacatatatgcagtaaagacatttttagtgacagaacaaagacaactggatgacttaaccctgggttttcgagttttatgccaccgttatctacagattataagctgtggctcttgtaaagaaaggtggaagaaatcaaacctagtgtattagccacttaaaagagaaatgcagagaggtgaggaaacatgtatttcagtgcagtttaagaagtaaaaatgtccaagatcaaacctctaagtatacttattagaattttaaaagagacatagattgagactcagataggttgttatttcaacattgagcctcatttggatgggtatttcctattagattgagagttttgccattttctgagtgtgtttaatttccattgtcataatacaaaagaagtgttgaggtcatgacattatctgagacccataaatagaagagaaagtgaacaaagtagaaataaagttgagataagtacaaaaactgaaaaccctaatctggttatgtaagaatctcacaacaagaaagtgctgagacaggtgggtaaagactcaaatggcctagccagctgtatcccaccaatgacccggccaacctcttccctagtgacactgaggatgatattctgcagttctctctgcagctttagctgtggcctagcccagagccatgggctgccataaataggtgaccttcaaagttctgcaccaaattgggagaatctttcttttcttcctgtctgaagaacaagaatgttttttaagtttcccctagagcagccgcatggcaccaaattccaaaaggctcaggccaccaatgttcttcatgagatgatccagcagatctccaacgttttcagcacaaagaactgaaattcctcactgggcttgatcagtagctagaatttctggagacctgtttgggtataggaaatcaaagagaccttgagtaggaggactccagcctggctgtgaaggagtattcacaagcaatcagtctctatgtgagaaagaaagaacacatctgttgtgcctgggacattgtcagactgcagattaagaaaggaaaatcaataaatgctttctctgtgttaataggctcatcggaaatcccaggaggttggaaaggaaacttagatttagacccagtatcagtcaattgggtctcatctactaattatgtggcttcgagcttgtaaatattcattcaattcaaagactttcctttctgcttcatttatcgatatattgagtcatttttgtaagactgtgtttcaataataagaaattgtacttttttgtttgtttgtctttgacagagtctcactctgtcacccaggctggagtgcagtggcagaatctctgttcactgcaaactccgcctcccgggttcaagcgattctcatgcctcagcctcccaagtagctgggattacaggcatgcaccaccatgcccagctaatttttgtattttcagtagagatggatttttgccatgttggccaggctggtctcgaactcctgacctcaagttatccactcaccttagcttcccaaatgctggggttgcaggcatgagtcactgcacctggcaaaattgtacttttgaatagggagaaattacatttttagcttgtaataattaaaatttatccaatgataattgctatattttcaaaatttattgtttataaatatggtcagctttgccttctggtttctattgtttggtgaggatggagcgggtacttaaatctttacagtaaaagtcaggtcttactcaaaccctcaaagagatacaaagtgcccttaaacctttaatctgctttcaaatccaaaaggaacattaagtctatttattcataaatcgttttaaatatctctgctccaggcaatttacttgtcactgtgaaaatattggtaagttaaataaagactttattttcttcagtggagcactcttcctgagaagacagctctaaacaataagtaggtaggtaggaatcctagggccatgaaggagatgaacaattcacatagattataccagctgaagtgaattcagttttacttatgtttcttagataagtcatatctgatgaccgttgattcagtttcagcagttgcatgaactagaaactaaagtgaaatacggaatcatccaccttgaaacttcaaataagtagcaaataccttttatttgctggctctgtggatggtgctagttacaatgaaagaaagtagacacattctctgctttcagggaatgacagagcttccagtctggtgggatgtgggcaagtgagcatttaattaaagtaatgctaatgactgtgacagggaaagtatcagattctggaagcgtgtagcacttgtttccgtcagggaaagcatccaggagaagtaactgctaagctggcatctcaaggatctgtgggagttaaccaagtaaatgtgtgatgctcaaagggtcagaaacagggaacagcagatgtgaatgcgtagcggccagagggcgcatgcaggagcaaacagtgaagaaggtttagaactatgtagaagtagaagggagggagggagaaagcagaagttagaataggaagcaggtgttgtattgtaaaaggcattgcaagcaattatgggattatgagtcacagaaatgatcattagaaatattgagatgttttaagcagtgaattgatgtcaccaaatacatattagaaaagctcttacagctgccctttgaaaactaggttgggatttgcttgcacatactggttagaaaggtgggaagtggacccattaggacatagttattgtacccaacgagataggtaataggtttggaaggtatttattacgttgtagtaaagagtaaagctgaatgtaagactgatgactaaacagaggtgttaagatgtggtgcctgctgaatttttgggatgccatagaaacaagctctagactaagcctccagataaaaatatcaaaaattaaaccagagaactgtccagatataaaaacccactgttgatgatgctgctctagtaagaactagaaggaacttccattctctaatgccatttcttttcctaaaacctgaacttcccactatagaaagccaccaactcagccaataaatacagaaacaccacgtagagcctatatcttcttgtggacacattaggatcaaaagctcatgcaggtgctccagatcggcaagtctttctttgttcccatgtcctatctacaagggaggcttgaaatttacattatgttgcctgcattggtgatctggttttccattgatgcataattaatcaaaaactcagtggtttaaaacaacacacatttattacctaaaagtttttgtgaatcaataattcaagagcagcttcggtgggcttagaatcgctcatgagttgcagtcaagatgccagctggggctgcagttgtctgaaggttctgtttgggctggcggatctgtttctaacatgggtcactcacacggccactgacaggaagtcttagctcttcatcacagtcacatgggcatctccatggagctatgtggtatgtgctcacaacatggcagctggcttgtactagaggaagtgatagaagagagataaacatggaggaagtacacaattttttatgacctagtctataatttaaacaccattgtttcattgtattcattagatgggaatcactaaatccaacacatagtcaaaaggaggaaagaaacgagcatgagaaaatttgtgaatatattttaaaacaaccacaactagaattcataatgtgagtatcccttaatgtagaaagggtgttttacagatgataagtaggcatggttatgacagatgatgaaactacagatatcaaaaggaaagtgactttggatttgggggctgagtttcaatggatctccttgatctcctataggcattcccaaatggtagccatgaacctcttgcaagtggctagactatctactaagtaagtggtaagggtgaatgggaagtgtagatattgcagcccaagaagtgaacaaagtagacataccaatggaatccataacttattccccttgcaggataaagtatagctagtccagggcatgggagagattattaatggagagccagccttgaaaattaaaaattgtttttctggctgggggcggtggctcacgcctgtaatcccagcacttttgggaggcccaggcaggcggatcatctgaggtcaggagttcgagaccagcctggctaacatggtgaaactccgtctctactaaaaatacaaaaattagccaggggtggtggcaggcgcctgtaatgccagttactccggaggctgaggcaggagaatcgcttgaactggggaggcggagattgcagtgagccaggatcacaccactacactccagcctgggtgacaagagtgaaactctatctcaaaaaacaaacaataacaacaacaacaaaaaacaaaatcaaaacaaaaactctttttccttaatctttgagttaattgatgtcttcaagtatgtgtatatacatatatgaaaggttttgtgaaatctgtgattttcttatctggagaaagatggagagagtaataaaaaattgaagtaaacactgcttagtatgaagaaataaacattacactgactcacattaggtttttatactgagtatgttttggttcatgatttgacatgaattagaaataagttttaatggatcactaattcctggctggaagaatgttttgacttctaagtgataaagtatactccctaagtaagataaagctgtttgaatcagtagaagttagacctgcctcccatccccaccacatacaaacatgtactctgttgactggcacttgggtgaaatgaggcaaaaaatgataaacttccattataagagattgtaaggctgtattgtaatagtcttttggaagatggaccagtaaagagctagacatactctttggacttacaattggagaaggggctctagacaacgaaacttctgaagtttgggttacttagttgctgtcaacagctttatacacatcttgttctaagattgcacgaaatctaatcttgctccttcagttctatgtagaaaagatatgtgcactcttgatatccttcaggaggcactattaagagatcacttgttgttatacacatccatcttgagggaaaaaatgcttggtgtaagagaatattttgttctgagacaataacatggagaatgaggaaatgggtagttgatgccattcttactgttcacatagtcaagaaatagactttctttgagcccatgggtggcactaagaaaaatctggatcagctggtccaaaagctgttttacatcaaacacatgtatatgcttatgcatatgtgtgtctggctggccgggtgaaaattatgtggctatagcagtcatgatttgatcctcatacccaaatgagcaaaccaatataaaaatttcttaaatattatgaggttgtcatatttacttataaccagatataatgcatattacgtcctttctgctgtggaaaagatttactctatacatgtctttgtgatgaggctgtctgctaaaaactaaaaataaaaatggtatggggaatccactcaaaggaaaaagcaagtattgggtatgaatgcttagaatccagatgaaatgttgcagattttaaaattaaatgtatatgaatttataaataaaataaaggtcatagctatttaaatctgtatttttaagtaatataaaaaataattcttctctttgatctaccgtaccccaaaaattaccaaaagtttttaatattcacttatgtaatttatataagctgccaactttgaactttcacatgtgctataaaaatttctgggttttgttattactgttgttttgataaaggagatatattttctgtaatctagctaaacaaagacttttaattttaaccagtagatggcagaataacattagcccctggaaagcagttgctctgagactgttacagaggaacgacctattctgtgtactagtgcatttggctcaggtacacaattcaacagttatgtgttcagtcatccttaatgaatatctaagtcttttattctaatcatcatccagccattcaaatatatgctcaacaattgaatactagaggatgcagataaagtatcaaaattaaggtgggaagaatctttaaaaatccatttaaaagtattttaatggaaggtctaatgtggtcctattaggaagcaaataatagtatcatgctgagatgactatttctggcctattttctgtcacttattaattctagaaatatacttactgtccaaaaggtatgaaacttgaaagatcattttactacttttgccaaattgcattctaaactgtaaaccaattgacaatgcactcagcaatatgtaagagtcctttctaacccaacagttgaaaacaattaaaaaacagactctttttcagtatttgacatgagaaaaattaaattatcatctcaataaatttgactaaataaatgaagaaatgggtagttaatgacacactgatcacacagcgaagaaatagcctttctttcagcccatggatggtactaagaaaaatttggatcagctggtacagaaatcatttgtaatgaagatacacaaccctaattttttaagactcctaattaatgaggaacttcgtgaacaagatcaaggatatttccttgtaacaaaggaatcctaaaactagaattacccctattaaaattacgcataagacacaattcctcggtcactactataattttgctggaagtatgaaccatgctttaatgtttcacattaaactaataatatgaaattggcttttataatatgcagataatggttagttaaggtgaaaatatgagaattgacccaaaaaactgaagaatcaatgagagtcggtagacagaaaaccattatgctaaaaccacatatttcctacttctaccaagagttcagaatataacataacgaaatcccattcaaagcagaaatacacaaacacacacacacacacacgtatatatcaaagacaacttaacttgaaaaaagatcattggaagtgaagaaaaatactctaaattgattgactataagattttatgattttttttaaagcataaaaattcagcaaggaaatgaagatattcaaaaagtggttatggaaaaattaggtaatttgaaaaatacattagattttatgccaaaagtttggtagaaagttgtatcaataataacaacataaaatactgggataattatgccacctaatgataaaaaaattattcaagaaagcattaaaatgacaaaaaaactaattgtgctacgttacaaaggaaaaacacttgatttctttgctcacagaacacaagtgggcaaatacttgctgtaaatagagaataaagattaatcttaatatagccagttgcagtggctcacacctgtaattctagccctttgggaggctgaaataggaggatcactggagaccaggagttcaagaacagcctggtcaacatagcgagaccccatctcaaaaaaaaatgaatgattaatctcaatataaaaaggtaagtttattaattttaaggaaaatctcattctcattttaactagaaagaaaagctacttgaacaggagacaagcagtaaatgccaccctaacatgtcaagaactagtaatcacaaagctatagagctatagtatcaagaacaagtaataccacatcagtactatataacaaccaccaccaccaccacacacacacacaccccaaattaaaaaaaacaaaaatatcaccgaaaggtcaacatacaaaaaagacgaacatacttgatcatattaaattgaataaaaaagtagagtataaaaaagtatttatagcaaataggacaattaaagcaaaagacaggagcaaatgatttatgaaaaatacacatgctcaataaacaagaaattataactagtaattaaagatatgtaaatccaaacagtgaaataactagaactgcaaagatttcctttgaaatagttactgaacacagttctgctaaaaatgcatatggtataatcctggaaatattttttaagaccctaaaaaagctaacactacatgattccgattttacttagcatttatcatagggtagtagctatgggcaaagttttatgtaagaatattacatcttgctttattatggtgaaaatttatggtagacatttaaatatctacacataaggaaatggaataatttggcatgttcatggaatgaaatattgtatagacgctgaacactttcaaagaacaatagcctgaaaatcattaagctgaagcaaaagtcaaaaattataaaatcccaactttgttagtaacaactatcattcactgcttttgtgcatatcttatgctaatcgctttatattatttccttacaaatctgatataaatagaattattaatgatcacacccaacctgatagatgtatgacaaagctgaagttttagagagttaaacttaccccacaatctttcggcagttgtttataatcggttgagctggggatggcacatttatgtagttttaaaatgtcctgtaggagcttactgcctttatagtgagaacaaaataattttgattacaaaaatctgaacatgagtgaaatgtgtttgctttgcaggccaactacataaatattactgtaagcaagtgggaaagaaatttaagtctggatttatctgaataaaaatggaatctgtttttctaaatacatgtgcatttgataattagaaaaaaacaccttatgattttttaatatatacagctttttaaaaaataagagaaagtcatgataataggagtctttggaaggtggatttattttcattatccagcttttagcctaaggtctggcatacttgaaaaatatttgacaaatgcctgcacatatgtacgtatatatatatatataatatactattaatagaaattatcttcaacatgtggaatcactgataaattagtttgcttttattttcctgtacgttctataatagacatatcaaaaaagctaacaaatgttaatttttgaatactttccgaaaaactaaaacaagaaatgttaacataatgctttatgtgcttttagtttttatcctctaaatatttttccagtctgaactttctttaaaaaattaccagcttatgaaaataaatctctttccatttaatcatttcaaccacctaaaatttctctctataagaaactccaggtttaatgagcagtacagattgaatatcccttatctgaaatgcttgggaccagaagtgttttggattttggaatatttgcatgtacatgacgtatcctgggggagggacccaagtctaaacaatattacttaaaacttcggttatatttcacgtttcagacacgtagtctgaaggtaattataatagtcttaataatgttgtgcatgaaacaagtcttcactgtgttttgagtgtaacctgtcacatgagctctggtgtggaattttctacttgtggcatcctgttggccctcaaaaagttttaaattttggagcaatttggatttttggattagggctgctcaacctgtattagcatagcattagtcagctacctgtatgattaccaagagaactgtcaactgcagaatacgggaaagtaaaaaaatgagaggcagggtgggtgaagctggaggtgggggatgtagatagagcagtttacctagtaaagcaatacttatttcaataggaagcaccaggttcagacataagatgtaataaaaagtactttttttcaataaaaggaaaagcctgtacaaaatagaggcagggcagtatcaccttgatatgtcagaataagcactgaaatactacataaaaaataaaccatatcaaaattatcccctaaccccatctctactaaaaatacaaaattagccgggcttggtggtacatgcctgtaatcccagctaatcgggaggctgaggtgggagaatcgcctgaacatgagaggcagaggtttcagtgagcacacatcgtgccattgcactccagactgcacaacagtgagaccctgtctcaaaaaaaaaaaaagacaaatttgatctcaaaaattaactgaacagcgttgcctttgtaaaactacaacagattgagggaagaaataaatgcaagcaaatgcaagttaaattacatttattatataaagagatcctataacttgatacgaaaaacaaagcaactccaacagataacagaagggcaaaaggacaggaacatctgatcaaagaaacacagctaccgatagcacacaaatattcaacctcattaataatcaaaggattaggatgcacttcttgcttattcaataaagttaataatttctaatttttctacttttcaaatgtactcaaatgtgctatttttagtaataaaaaactgagtaattaaaaaaacatagaaagtatgaaaatttctgccaatgcagaaatcataaacagcattaaaatgaatcaacacttgtatgggcagtaaggttcagacccctagaagccaattcattttgccttggttcctgagttttattatgggattgtcaataaggagaaagttgttcctgatttacatgctgacaatcttccaggtatagggggttgtgtgtgtgtattacacacacacacaatgtatatataaattttttttcttcaggtagacaattattccaggaaagtacctcttcagaatcactcattacagagaattcctgtaactccatttgctgataaaagtcccattaaaaattaccatgtggttctcaaccaatagggatacctttggcattgaagaggctgagggttgattttagtactgcttgtaagaccatagtgttccagaggctctgtagctggcttctttgggaatctgaagttggtcctgtctttgagacatggccaaaagcacatttttcctcacttgatgcagaagaaaatgttatctcctgcttgctcagatcatagcctcgaggcagatcacacagctcaggatgcacatggactggaacagcaccagggcaagcaccccaaatcacaaaataatcatgttaggatgactaagttgggaggctgaacttaaaaccctatagctttgttcagaatatttttttctttgcttttttcattaagttttactgaccaaaaaggtggaaaaaagaacctaaattttctgcacaaaagcagttctctgaaacctgaactttaccaatctgtgtaaaagtactctacagaaaatacacaagcagaaaacagtaatgtaagcttcatctgaagtaacggtttagtcacatgacaaatttggttgtcgatttagtatgctgtagcccttatctatctaaattcagtatgactacatagacatttattctctggtactgaatttccatttgaatagaaacggctgctttgtggaagaaagaaacttcaatttaaaaacaatttcagcatcgttgaagtgccaatcagttttcaaattatgtgtgtgtatacatatgtatgtatgtgtgcatgcatgtatgtttgtattatgtgtattttttcctcctctctccctctcttgctcgctctagagagagataccaaatactggcttggtgctatactgttttttcctagttaatatttttattatttctgtctacgtaagaaacttcaaatattctgaatgcaaccacacaatcgagtaagttgacagacatgacaaaaactacgaaaagagggaggtaactagtattaatacttggcaacctttcgttatttttagtttagagcggcctccctctgacattttggagtcaaagatgaaaactcaactttgaagcataatggacataattacacatttaccacagtcatctacaattttatataacatcacaaaaagacatctaaacatttttctacgtctttttttcatttgttaaaacagctatgttaaatacattttcagaatgcatttgttagccacttgataaacatactaaaagccatacaagacgaataacatcagttacctttatatctaataactgtaccaatcactgtaagaagatacaactgaaggggaagtattagatcacccatgacgtactgcaaaggtgttacaccttagacctaagaatgatctgaaggtgctgaaagaggtgattctctagaaggtgacccagggttttcttcaggtggaaaaactgtgagtgtacaggctcgaatgccaccaagtgactctggaagatcaaaaactttatgccactcatctttttctgggtcatatttctggacaatttctaccatacaacgattattccaagaatatccaccaacaacatagattttattttcaaagacggcaactccaacatcactttggcctcttaacatggcggcaattggggtccactggtcaagggttggtgaatagtattcacagcttagaacatcatcataatcacttgttcctctgaagtgattgccaccaatgacatagagcttatctccaactgtacacatgcaatgcagacctctgactgtagtcattggagccttttgcatccatttatctgtatctgggtcaaaacacatgagctcattttggaaagtgtcatgggtaattcctcctgaaatatacattaagcctccatatactgttccagcatgaccatagtggggttcactcatttttgcaacatagctccactcattcattcttgggttgtaacattctactgtggccagttcaccagctgcactgcgcccaccaactgcatacaaatgtcctttgagggcactcaagtgaaagaatgtgcgcttttcatttaatgatgcaacctgcatccatttattataccgaggatcaaatctgaaaactgtatcaacagcagtttttccttttgtatcataattactctgaccaccaactacataaagaaagtttccaatgacagcaataccatgctggtaacggggagcatccattggggctaaagatctccattcttgtgccctttcatcatacatccgtaattctttactgacaaccagctgctgcctcaaaactcctcctaatgtaaccaagtgagtggagtcagatcgaatggcagttctatctgactgcatcactggctgcatatatggcatcatttggtaattgctagcttccaaaagcaaattcacgcaggtattgtctgttctcatgaaatctactgtctgcacgtaattgatgagatcctgtggtgtcatcagtggaaatcgaatattcttcattaactttgcagcataatccatccgagggtcttccaaccttagccagcgacaggctgccttaaagagttcaagttcggtacagtgcttaagactattactggaaagcacaaatgcaagtcgttcaaaagggagttttagaaactccccagtactcaataaagcaggaaagttcttcaggatgaaattattaacatatttatccacttctataagattgtaggtgttagcaattcgtccaacctcaacacagttatccaaagagactcctgatataagaaatactttacagaaatccaaaacgggtaatatttgtaaaaagctagcagcttcaagtgtgtcctgaagattgtccatattaagagaaagttttgcagtataaataaaatcaatgattttcttcagaccaaccttgttcaccccatgaagcttaatgcacatcaaatcttgttctttcattccacctgtgaacatggctttgaaataatcactagcagacgccatcatagctctgtgaacagggaagatttcatctccatcacctggtaccagggtcacatcacaaagcaatccttctattctaagctgatcaaagccttgcaataccaccgaactgtgagtattgctggtaaaaaagcgtgtggttcctgccttacaaggctgcaaatgggcagagacgcccatttcgccgttaccaagggacactttcatgtgaaagctttcctcttgcacagagatgcaagccggataaagaagttataaccggaatgttttacaggtaacgaggtgtccagaaagaacagaaagctcgtttccttatcaagggaaggcagtcactgcggcacccctcgggccacgccagtcagtcatccactgaaaatcaccctgtagcaggaccacaaagggctgtggacctcaaatctgattattagacagatgattcatcacctgaaggcggttaaatgacctggttcacctcgtccggcctgcgctgccgctccttcagcagttccgcttcgggcaaggaagaggcgccgccacgtactgtggctccacggcccgctcggcggcgggtccggacacctcagcgaacggcccgctgcgccctccgctgtacctagagtgtcgcagcggccaccggcctgtctttgagcaagggccgggaacacaggcctgggcctgggcttgggcctagaataccggcctagccccaacaccgagccgctccttccggaaaagcctagtcccaggataccacggggtgggagcggccttagcggctactgcggctgcgcggcctccagacctcgtcagtcagcgggagggtgggggtggggaagggggaggaagtacccgggaggcgggagggcgagggttggggaagcggagctgtgtggggtgggcgccagcccggcctcttagagctgccttgtatgtgggaccaaataggacagaatgtgtgcaagcaagtgtgttatgctgcacgtttgatataagtttttcgcatatctgagctcttacgttccccaaatgcataatttttcaaagctttacgcttcctagcttctgtttttttgaataacagtgaaatgcggcatttgtataaattgagaggaaacctggatgcttaattttttttttcctctacaaaacaataattgttatcccacattatgtagtagatacttcagttacaattttggttcatattttcaaatttgttacaatttcaaacgcaaaatatttgtctttactagattgttactttattatgtaaatgatatattctaaatttttggcttgaaatgcctttgttttccacaattttaaaaatggctacataattttccaataactatacatactatagtttcctttgcccattggtttgttcctgaatgtgtaccttcttatcctccattgttttatagactcggtagtaaacttatacaatctggtagcaaaattttagccctgttatggataatatttagtaaaatactgatccaagacaatatttccaaaatattatcaccaacaatgtttgtgtctttcccttcttctgacttttccctttgtgagtattttattaacttgcatttctttaattagtggtaaatttaaattttgacatacaaataaatgtatactttgacacaatttcttccattttccaaattttgaagtttctgtcttttaaatccttctagttctttatgcatatgcaaagtaagaatgtagtcatgtttttcttacactcgcctcgtttttatgtaaaagatagcataccatgtacactgttctgcatctttttttttcacttcaagatcttcctgaattagtgtagagggcttatttatatttttaaacaattctgttgttgccttctgagttgttacatcataagttatttaaccagtgccctgttgatgggcagttcatctgttttgaatgttttctattgtttccaagggatggcagcaaaattcagaaggcttagactaccactgtcctccacaaggtgctccagcagattgtcaccttattcaacacaagaggttggttggaatgaaactggcctggagaaattattcactgaatttttatcagcattgggaagtcctggagccctgcttgttgaatgagttaggggtggaagggctctctcaggccatgacaactccctaatgctgtgaagagctacttccaaggaatcagtctctatctggaaaagaaagaagagagcctctgtacatgggaagttggagcaagaaatcatgagatccttctttttttcatcaaacttgcaagtaagattaatagcttaggaacagacttgtgtcttcatgaaatgattactatagacactcttcattatattcccatatgtttagttattttaaaagactatcttttctgcctgcataatgaaatgattgaatcaaatttgtcacaatacttgttggtaatgtcaagcaactgtatgataaagcatccagttcttaggggcattagctcaccatggatgatattattaatttacccatgtacttaattattgattctactacatttattgtattcagtatttttgcttgtatgaaatgttcacttttaacactgtgctaattacattaaaaagtgttcactttatgtatattttgtttgtttgttttgttttgttttgttttgacggagtctcgctctgtcacccaggctggagtacagtggtgcgatctcggctcactgcaacctccgcctcccagggtcaagcaattctcctgccttagcgtcccgagtagctgggactacaggtgcgcgccaccatgcccagctaattttttgtatttttagtagagatagagtttcaccatgctggccagtctgctctcaaactcctgaccttgtgatccgcctgcctcagcctcccaaagtgctgggattacaggcgtgagccaccatgcctggcccctcactttatattttgaaaattattctctttattatttcgagttttactttcagatcattttgcatttgtttatttaaaaaaaacaaacacaaggtcttgctctgtcactaagctggagtgcagtggcaggttcatagctcactacagcctcaaactcctagcctcaacaatcctcccacctcagcctcccacactgctgggattactggcatgagccaccatacctggccttactcaataaatcaatgccaaggttggttttgcaacctcaagtgaagttcagttcattcattccattcacactgtatgaaacacttgatatgtgacttttcaggatagaaaagtgaataaaggaaacacagcttcagccctcttgaaactttttgctgagggagaaataaaactattaaccaattaattaatttcaactctatcataaactcaaaccataggcaaaagaaaagtggtttttgtcatcagaaactggaagactttaagccttgaaaattggatacacagttctgggatttagagtgcatggctagagatgttcatttgggagctgggctatacctttttcctgaaggcccaaggatggatgaggtctggtagaaattgagtagtgaatcagaagaccaaaacctggatcttgaggacctttacatcttaatgtagtgaacagagtgaggaacctgaaaagggcatgtgaatgaaatgataggaggacatccaggagcaaaataggaggacaaccaggagaaaattgtgataagagggtgtttaagggaagaaatgtgtttaaaacatgacgttttacatttaggaaaagaaaggactggtttgccagaattaatttggcaaaatccagattggaatatattgactagagtaaatagcaggagaggttggagacacagtggatggaaacttcttttagaagtttatctgtgagtggaagaagagcaagaaggtagtacctggagaaaaatgtgtgtttgtattatcggatataattttgtaacctttttacaaacttttatttaggattgatttcagggaatggatataatggcacaaagcatataaaattaatactttatttcataggctatattgtcttactgcttatttaataatctaaaatttcaagaataattgtttaatagtttttgagtactagtgggctataatgcctttccatttgcttcacttgctgttcttaattctatttagatttcattttatggcattaattgtagtttttattgttcttatgaattatgcttttatacgcccctcttaaaagtatatataaaccctttatgtagatgttagctatattccctatgatgcaactttctcgattttgtttacatataactgttattttcctttacatttctcctattgccagacaattgagaacatctaaaacttatggaaaatgcgtttgaaatcctacttctttctttcaaacaaatgggctctctttattaatgtggataaataaaatccaaatactcttcagagagagtgtagatgactgctcagagagctcatttatcacattcttcgtacaccagggatgctaattgtgcaaaaatactgaaacctaagtaaggctggacaaggatggccatcgtagtaaaggccatctctgaccagatggggatgcttctagggaagtgtatttagctgccatgcagagaatgtctgcaaaccaccacgttgtgagtttattgattcactggtttcctattctctactgcctagtcatgaaacccactcatactttggtaacattttataaatttctctcttagcagagatgatatgaggagtgatctgcggatcagtattgataagagatgtcttgaagacatccatttagtgaatggtgaggggcagagataggattcatagctggttctacctgtatgtacagtgttcttttctctgtgtttaatgtatctaagttagactttgttgtttgtcatgaatgcagaattgacaagagcactcaatactaagaaggcattaaaagaaaacattgtttttgatttctttcatcagtgttaagaaagaacagggaaagaaaaaatctattattatgtgccatctataaaataaataatatgttacatgttttaatccaccagttacagtgtaaatagtaatactatcaagcttactttatcaatgaagaaagcaggacgctgagagaaaaggtgatccacgtagagtgcacaagtgattggcagagttaggatttgagtctaggtgtgctgatggaaaacttcatgcactcagtggatatcatgtttccccaaggttgggggctatcaggatcgggtaggttcttctttctttctcttcttcacaagttaccctgttggagacccaaactcacagcgtctgccctactcactgtgcttcactcatttcctcaattattgtcttacctgcctgtggcatctgtctgggtcacagacagacctcctatcacctgcataagtgcagtgaagaactcaggtaccccaaggattctgaggggttgagtaacacataaatcttcagtaaagagacgggcctgaataggacttcttacaagtttagcaccaaccatgtccagagtgcctagctggcctcactggagaaaaggattactcatgaaatcctcttggtctattttctcctgtcctttgtgaaatggtgaagaaaataatagaccccaaactgttctcagctcacatattctcctttttagctgtggcctttgggcaagtctttttccctcagagatagatgcctgctcacagggtctgagccgtaagtaggaggaagtcaaaaggtatgtgcagaacaatctacaaagtgctatgtggtggttagtggttatttctctaaacacatctaattgtattgattcagactgttgatcgagcttgccatgctattttagacagcacaatttagtgactaaagggtatgactctagagccagagttcctggtttggattccagctctgctatttaatagcaatatgaccatggcaagtaccatgaacattatgctccctagtttcctcgtctgtaatatgggaagaataatagtattgatctcataggattattgtaacaatcagattaataaatacgaaatggctgaaactacctagcaaaaataatcactgctgttagaagcgagagtgtctatccccagggcagaggcagaagagttggtcttacttaggtactgactggcacagagcactagagaggcttctaagtcctgagcaaactgtttctgacatgctgctactttcacaatgtattcagtgtgtgaggaaccatgtcactgtgtgcgtaagacgtgtatactttcattctgtgtgttatgctttcaaaaatgagttgctttttaaaaaacaattgtgctagaaaaaattcctgggatagcttaagatttccaaagactagtgggatccaagccaatacatatatatatatttcatctatctaaatagctattattaacctgatatctaatctatatttacctatctatatctatatttatctatatctatctatgtgtacatatcagatcaaagtttttccaggggctcgccattgctttccatgttggctctacacaagagagaagcttgtccccaggttcacctgagatgggatggggaagtggctgatgaaaaggtattgaaaggctgtcctgttcaagtgtgctgaactcccttcatcagccaattcataaccctgaatcacaatgtttgggattttactctgaagacctctctcacactcagataaattatttgtgacctttggttagaagccctaggccctgctgtctcccctgacctgccttgcctgttctctaagtctaatgatgttctcatcttttcccagtactctcattcctgatgtatctgtgttccaataattaattcagaataatggaaaatgatatttgggcccttttctttaccttgcctaattgatgtctctgctttctacgaacagtggtagtaagtcagatgtgggtatatcaatcctaatcccaagaaccacaacatttttattctttccccagcacctccttacccctcaagttagagaccacatctttaatctgaccctctggcctaatgtgcacacagccacctatcttccaatttaaccctccctaactccctctaaatgtgctggcaggagtcagctcatcacaattgagaaattttggcacatcattactggaagatgattgcttttgtccttcaaacagtcaattggccaagacagcagagtgttgctgtgattgaactaggttgtcagcagtgatctcctctttttttgatctggtactaacgtcaatattttcatagccttcagatgataggagcaaaaatttatgttcagtgtgtgagcgtgggcaggggttgggtaaattatcctttgcaaaatttttatgttgaatagcaaaattaattttatttttccaaatgtggattatatctacgttgaattcaattcattaaattgctgaatactttttatgctttaagtttctaagctggccacaggggattttatgatgattttgcttccatcagattacattgttctcattggtttcaaagaacttcttgatttctgccttaatttctttatttacccaggagtctttcaggagcaggttgctcaatttccatgtaattgtgtgggtttgagttagtttcttaatcttgagttctaatttgattgccctgtggtctgagaaactgtttgttatgatttcagtttttttgcatttgctgaggaatgttttgcttccaattatgcggtcaattttagaggcagtgctacgtggcactgagaagaatgtatattctgttgatttggggtggagagttatgcagacatctgtcaggcccacctgatccgaactgagttcaagtcctgaatatctttgttaattatctcgatgatctgtctaatattgacagtgggctgttaaagtctcccactattattgtgtggaagtctaagtctccgtgtaggtctctaaaaactagttttatgaatgtgggtgctcctgtattgggtgcatgtatatttagaattcttagttcttcttgttgagttgatccctttaccattaggtaatgcccttcgttgccttgtttttttttttttttacctttgttggtttaaagtctgttttgtcagaaattagcattgcaacccctgctttcttctgctttcattctcttggtaaattttcctccatccctttattttgagcctctgtgtgtctttgcaggtgagatgggtttcttgaacagcacactgataggtcttgactctgtccaatttgccagtctgtgtcttttaattggggcgtctagcccatttacatttaagtttaatatttttatgtgtgaatttgatcctatcatcatgatgctaactggttattatgcagattagttgatgcagtttctttatagtgtccttggtctttgtacttcagtgtgtttatgtagtggctggtactgttttttcctttccatatttagtatttccttcaggagcgcttgcaagacaggcctggtggttatgaattccctcaacatttgcttgtctgaaaaagattttacttctccttcacttatgaagcttagtttggccggataagaaattctgggttggaaattcttttccttaggagtgttgaatattggcccccctctcttctggcctatagggtttctgctgagaggtccactgttagtcggatgggcttccctttgtaggtcacctggcctttctctgtggctgcctttaacattttttccttcatttcaaccttggagaatctgatggttatgtgtctttgaaaccaatgagaataaagagacaacatatcagaatctctggaattcagctaaagcagtgtttagagggaaatttatagcactaaatgtccacattagaaagctggaaagatctcagatcgacattctaacatcacaactaaaagatatagaaaagcaagagcaaacaaatccaaaagctagcagaagacaagaaataactaaaatcaaaggaaattgaaggatatagagacacaacaaaaccttcaaaaaccaatgactctaggagatgttttttgaaaaaatttaataaaattcactgctagctagactaataaagaagaaaagagaggataatcaaatagacacaataaaaaaatgataaagggcataccaccactgaccccacggaaatacaaacaaccatcagagaatattataaacacctctatgcaaataaactaaaaaatctagaagaaatggataaatttctcaatacatacaccctcccaagactaaaccagaaagaagtcgaatccatgaacagaccaataacatgttctgaaatggaggcagtaataaatagcctatcaaccaaaaagaaagcctattaccagatggatttacaactaaattctaccagaggtacaaagaggagctggtaccattccttctgaaactattccaaaaaaattggaccttcatgttaaaaactctcaataaactgtgtattcatggaacatatctcaaaataataaaagccatttctgacaaacccaaagctaatatcatactgagtgggcaaaagctggaagcattctctttgaaaaccagcataagaaaagggtgccctctctcaccactccaaattccaaaaaaaaaaaattgggatggtttcagaaggaatggtactttggaatagtttcagaaggaatggtaccagctccctaactcgttttatgaggccagcattatctcgataccaaaacctggcagagacacaacacaaaaagaaaacttcagaccagtatccctgatgaacattgatgagaatatcctcaataaaatactgcaaaccaaatccagcagcacatcaaaaagcttatccaccatgatcaagtcagcttcatccttgggatgcagtgctggttcaacatatgcaaatcaataaatgtaatccatcatgtaaacagaactgacgacagaaaccacatgattatctcaatagatgcaggaaaggccttttataaaattcaacatcccttcatgttaaaaactctcaatgaactatgtattgatggaacatatctcaaaataataagagccatttctgacaaacccaaagctaatatcatactgaatgggcaaaagctggaagcattccctttgaaaaccagcataagacaaggatgccctctctcatcactcctattcagcatagtattgaaagttctggccagggcaagcaggcaagataaataaatggtattcaaacaggaagagaggaagtgaaattgactgtttgcagaccacataatcctatattgtctcagcggaaaagctccttaagctgataagcaacttcagcaaagtcttaggatacaaaaatcgatgtgcaaaaattacaagcattcatatataccaaaagtagacaagcagagagcaaatcatgaatgaactcccattcacaattactacaaagagaataaaatacctaggaatacagctaacaagggatgtggaggacatcttcaaggagaactacaaaccactggtcaaggaaataagaggggacacaaacaaatggaaaaactttccatgctcatggtaggaagaatcaatatcatgaaaatggcaatactactcaaagtaatttacagattcaattctgttcccattgaactaccattgacattcttcacagaattagaaaaaacctagtttaaaatttatatggaaccaaaaagagcccatgcagccaagacaatcctatgcaaaaaggaaaaagctagaggcatcatgctacctgacatcaaactatactgcaaggctacagtaaccaaaacagcatggcacttgtaccaaaaatgacacatagaccaatgaaacagaatagagatctcagaaataaggccagacatctacaaccatttgatcttcaacaaaccttacaaaaacaaacaatggggaaaggatttcctcttcaataaatgagaaaactggctagccatatgagaaaactgaaaactggaccccttccttacacattatccaaaaattaactcaagatggattaaagacttaaatgtaaaacccaaaactataaaaaccctagatgctggggaggatgtggagaaataggaatggttttatgctgttggtgggagtataagttagttcaactactgtggaagacagtatagtgattcctcaaagttctaaaatcagaaataccatttgatccagcaatcacattactgggtatatacccaaaggattataaatcattctactataaagacacatgcacacatatgtttattgcagcactatttacaatagtgaaaacttggaaccaactcaaatgcccatcaatgataaactgcataaagaaaatgaggcagatacatgccatggaatactacacgtccataaagaagaatgagttcatgtcctttgtagggacatggatgaagctggaaagcattctcagcaaactaacacaggaacagaaaaccaaacactgcatgttctcactcataagtgggagttgaacaatgagaacacatggacacagggaggggaacatcacacactggggcctgtcgagggggtagggggttagagaagggatagcattagaagaaatacctattgtagatgatgggttgataggtgcaggaaatcaccatggcatatgtacatcttgtaacaaacctgcatgttctgcacatgtatcctagaacttaaagtaaaataattaaaaaaaaaaaaaacccaagaagaaaatctaggcaatgccattcagtacataggtatgggaaaaaatttcatgacgaaaacatcaaaagcagttgcaaccaaagcaaaaattgacaaatggaacctaattaaactaaagagcatttgcacagcaaaagaaactatcatccaagtgaacagacaacctatgtagtgggagaaattttttgcaatctatcaatctgacaaaggtctaatatccagaatccacaagggacttacatcaatttcaaaagaaaaaaaaaagccaaacaaccctgtcacaaagtgggcaaaggttatgaacagacacatctccaagaagtcatttatatggccaaaaaacatgaaaaaaaaagctcaacaccactgatcattatacaaattaaaaccataatgagataccatctcaccccagtcagaatggcgattattaaaaatctcaagaaataacagatgctggcgaagctgtggagaaataggaatgcttttacactgttggtgggaatgtaaattagttcaatcattgtggaaaacagtgtggtgattcctcaaggatctagaaccagaaataccatttgacccagcaatctcattactagatatataccgaagggaatatatgttattctgttataaagatacatgcatgtgtttgtttattgcagcactattcacaatagcaaatacatagaatcaactcaaatgcccattgattatagattggataaagaaacatggtacatataccctatggaatgctatgtagccatgaaaaggaatgagatcatgtcctttgcagggacaatggatggagctggaagccattatcctcagcaaattaacaggaacagaaaattaaacatcacattttctcactcatatatgggagctgaacaatgagaacacatggacacaggaagggaaacaacattggaaggcatggggagggagagcatcaggataaatagctaatgcatgtgatgcttaatacctagtgatgggttgataggtccagcaaaccatcatggcacacatttacctatgtgacaaacctgcatgttctgcacatgtatcccagaacctaaaataaaataaaattaaatatagaaaagaaaaataagattacattgtagtaactactaaatgtccctagatcagtcagtcagtgcatttctactgaacttcatggtttgttattatctgtctcaaggtgaaaatttaaggcagtgaggtccagcaatgctgctagatgaaattagtctgctcttctttactggtttcagtgtctaaacaattcatatattcttttttttattttcatatttttctggtcaagtgctgtatggctgcttctgaattactttctattttatcttaaggtaaataccaacatagggaagtacaaatggaaacataaagagctcatatcattattttctatcattttcaatacatccttttattctttctccaaattaatgtttttataaattgtcattgcatttggatatgttgaagagaaaggaagacaaatgcaaatctgaatatgataaacatgaaagaaggaaagtgactccccaggccaaaaaatggtaataggaatttttcttttttttttttttttaacctttccacctactccaatatagtttctgcttgtaaattctaccaagtcaccttcactaaggtcaccaattccatctgtttttctactgtagtagatgatttcaatccatagagcagtttactgacagtcaagatagtattaaccaaaataatgatgttatcattataaataatttgatatgtcataatttaaaataaatattaattatactagtatgatttttcaataatcaaatccatgaaatctatctatagacatacatatttccaaaaatggaaagctatgcatataaaaattaattcatgtccttttccaggtcctactttacttctctccttcatttcatgatgaggcaggataggtagtcaaggaagtaaccatatcatcaggatgtcacaaccttggtgaccataccatcaccacaataagctttagcattaacattgtaattgaactcattcaagcaaagctgtagttcccctgtagagagaatgcacattttgattttacctgtcctcagagtgaccctttgctcattataatagtaaagaataaacccgtgggtagaagatttaagatgctaatgagacatacggtgttacaacaagcatatgcagttactgcacatgtgcacccagaggacaaccaagaacatgcttactagtaacgcctcttcccacctccttatggataatcatggaagattcccataaaaggagtctccctagtactagtctttactttctcatccttactagcagcctgccctgaatcctgtctgtctcagggtgtactgtctattctgcacctggatttcaaaatattcgttttcttttttttggcaataaattactccatgctgcatctccaccgccgtgtgtctcttgtttaaattcttaaaactagcaagacaagaatctaggtctcacatcagccatcagcaagaaggcaaacttctcaaaattgttttctctatatattgccattaccttctcttctcttatttactcttctacctactcctgtatggtttctactgattaagtctatcagtcaactggttgattctaccaatcaacttccactaagatcaccaatgcccaaattaccaggcagtttcaatctactctatattttgcatgaatgcatcaattcttctaagcagttttagtcctttaaatttattattatcaccattctctcttttccttctaatatttggccattccaaatctgtttccattgtagctctttcctccctttaaagttgaaagttgcaggaggaaattttcagtcattttgtcattctgtaaacacttctcacatgaccactgctgttcctggagtttcaggtcacggcattgcttgaaaattgcagactgaaatatcaaattgccagtgcacatttgcacttatgtgtctaccagtcaactgtagaagatatctgctgcttttgtttttgtttcctgatatgccttactccagctctgctgaaaaaaaatactgttttttggtcttcttcttatatcatttatctaacagatttaatgattattcttgtttttaggtttttttccctacacaaagaaagataaaagacagcatgaagtgtatttgtatcttcatctctataacctgaagtcaacttacaagctggcttatagaatgtaaatttgtactgtacttataacttgagtataataacaatgaatcaatgaattgaaccatacatttttaaatcatgttggagaatcggcttggtgtttctccttagagaataaacaaatccaagaagttttctatagtaaatatttaataaactaaacaaaataatacatcgactaaacatagaaaatatattttgttatgttatcaacaatataaaggtatacattttatgcttttatatgggcaaaaaattaaatattatagtcaaataaatatacatttaataaatagataaatagatccatcagcttagtcatctgtaagggactagttcctgtgcaactgaacacgatgttgcttaacacacttgaaaatacttgacgcgtttgattcaactcatggtatggttatagcagaaacaagagtctttaaaatggcagatcatgaaagtgcaagctggtgtagtcgtcaatgggagtcgtttctgtgttggatcaggtcttattccttcctccttaacctttcttgcaagtttcttgatgaagagaaggatctcatgatttctgctctgacaacctcccaggcacaagggctgtactttttctctgtcaggtagagagtgattctttggaagtattttctcacagccaggatggagtcctcattcatcaggggagtccctcccacccacacctcctgcatcacacaggcttccaggtcattcagctgctggtaaagttcagtatagagtttgtctagaagcctctcatcccaagcaacagatgagtcctttgtgctgaagaggttgaaggtctgctgaatcacctcatggaggacagagatggcttcagccttctggaactggttgccatcaaactcctcctggggaaatctgaagtcatgtctgtccttcagacaggagaaaagagagattctcctcatttgtgccaggagcatcatggtcctcctgtgacccaggctgtgggtctgaggcagatcacagtccagagagcagcttgacttgcagctgagcaccaccagggccatcagtaaagcaaaaggcaaagccattgtagatgttgcagatgctgttggacttgttgagatgggtgactctgaaccttcagctctaggttctctgaagaccttgctttatgtgtaggtcttaaatagggaacatactagtttccattttcagaatttactttctacgtctgattttgctttcatttatttactctctacatgggtatagagtagtttttcaaccagttttgtgtgtgtgtttgtgtgtgtatgtggtcattattgacactcccttctcttgcctgcctccagagtcttttaagaaatttttttcttaattgaaattaaatttttattaaattttaataacaaatatattgtatatctccttatgtactgtatgtatgtctactttgcacactaaaagaaaaagcataaagtttacttttattatttcttgatctgttaggaatggcaaagtaatttaactaaaagttaaatttttaaaaatttgacatttaacttaactctgagcagcaacttttaattcactctatttgtttatataaattatctcaaacaaatttgcaaattaagaatgtattagtaatatacataataatacaaacatgatgacatgcataagtttcttaaaggtaaaaaatgaaattgttttcttaagtttgatttttagtgtacttaacttttaattttgctttaaaaaataaactaatttttaatttcactagctgctacatattcatccagagtgtcagcattttattcttttcagcatttgacattaactgttgatgtgttgaaaatatttagtagaattaaataataacatatacatgatttgtatttaattctcaaagtctacctaatactcagaatccctgaagctcaaacataagcaacatctggaagaaaggcaatcacagcaaatgatggaaagaaagtcctccagtaagccatctattcgccatagatttataacactgattgtgcatgtattttgtctgtttctactgaattcaatgtcagtatgtcttgtgcgatacacaagaaaattcaataaggaaagtgaacactagagaataagattatgtaagaattgagctttggaggaccacaaactattgtaatatctgagagttgttcacacccccaagaactaatttctacaaccttgggggcaataccatctccaatagaaatacacaactttgaaaatatcatcaattttattttttttgtatttttgcattaaagttcaaattcctcaacatatatttatagtttctaaaccaagtcaattctattaaacaaagagaaaccatctttgtcctaaattcataactggataaatattatcatgttaagcattaacttacaactccaatcctgagcgctgggatttttttttttcatagcaagttaagttgcctcagacctatagattccctctcttaaaatggtaagtatggaatcatctttggcaaatcatctctttagtaactggactctgttctgttgactgcattatcctcagtaccaggcctagtgtacttattcaagaaatagtttttgctgaagcaatttatcatactttctctttatactagaaggcattcatgggtgaccaagctattttgtttccatcatggccatatttgttaggattataacagacaatggctaatatttccactctactcttactaagtgtcaataatgattatagaatgtattgccaaacccactggatatctaattcctttaaggtatatacggcactgggaattcaaatgcaagcacaacataattttcagcctttgcgtagcactatattaaactatattatgacctcatgtctaaattgccctctacattttataatataaattaaccagcctggtgtcataatatcgagccaaatgtccaaactcaaactctccctgattcacacagcttacagcaatcagacaacaaattacactacattttgtgggtagtacccctgtgatccccaagtcatcaatcttctaactttcctgccgttgtttaataaggccaacttcccagaatgtgtgtgtgaactataaattgttgggacttcatttttccatcacccagagatctaggctttaaatcatttgatgatatttagatgacaacagtataaaatcaacatgtctatatgaggatagagatgagataggatcagttttttaaataaactaaatgcattttagtatttattatttttagtgatttacttaaactctttatatcattaattaacttagactctttatatcattaaaatgctcagagttctgaaatggctacaggaatttccatagtaaatgaactttctttccaaaaatgtatcttgcaaaaattaataacttttataaggtaatccagtcaacacatttttattgg
